United States Patent 7,745,391 (HUMAN THROMBOSPONDIN POLYPEPTIDE) - sequence listing, part 35

SEQ ID NO: 79765 - DNA, 5464 bp, Homo sapiens
agcggacatacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaaggcaaaaagggcagctagctgtagaaagagctaaacaagtagaagagttcctgcagcgaaaacgggaagctatgcagaataaagctcgagccgaaggacatatggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacatgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgagatggagaaacatgccatttttcaatgaagattctaatattttatctattttgttcattgaattccatggtttctcataaaatatatactttattaaatcatccaaccaaagcataggaaacattgacccagaacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcactatcagtatgttgaatttattatgtatattatttctaatatccgaaactaaatacttgattttttaatatgtgtgtttattttatgatattgctattaaatttttattatctacctgaagtatat

SEQ ID NO: 79766 - DNA, 5410 bp, Homo sapiens
agcggacatacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaaggcaaaaagggcagctagctgtagaaagagctaaacaagtagaagagttcctgcagcgaaaacgggaagctatgcagaataaagctcgagccgaaggacatatggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacatgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgagatggagaaacatgccatttttcaatgaagattctaatattttatctattttgttcattgaattccatggtttctcataacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcactatcagtatgttgaatttattatgtatattatttctaatatccgaaactaaatacttgattttttaatatgtgtgtttattttatgatattgctattaaatttttattatctacctgaagtatat

SEQ ID NO: 79767 - DNA, 3825 bp, Homo sapiens
  misc_feature (2678)..(2678): n is a, c, g, or t
  misc_feature (3153)..(3153): n is a, c, g, or t
  misc_feature (3349)..(3349): n is a, c, g, or t
agcggacatacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaagaggaattctgcctggagttcgtccaggatttccttatggggctgcaggtcatcaccattttcctgatgctgatgatattagaaaaactttgaaaagattgaaggcggtgtctaaacaagccaatgcaaacaggttggactgtgatgatccatgaattcatccatgtgtgtaattttgtcgtttgtcatacatagcttagtacctacactttgtggatgttttctccattgttcacatatgatgttttttgcctcttgggtacaataattttctgaggtgcaaatttggcccttgattactctgtgaaagcatgtagctttccagttcagcctgatttttgtgtcttgtttgtgggtttagactgaatatactatttaaaggaacatgtgataacattctgccaacataattataacattttatcacccacttcctttaaataaatcaggatataaatctaaattgaatcacactttatgcagaaccccagtgcatttttcgcccttttcttcatcacttcaaagcctacttttctctttgttgtcttagcatgctttctcttcaccttcatctctgatttataactctttgtgatcctgttcatcatattatttcttttcttccattgaattaataatggtaactgattaatatgtacttgagnagagataaatgattgaggtaaatataaattaacgtttatatacacattataaattatatacagaagcctgatatatgaagcatctattttttgagaaaggaaggttacagacttacacatatgcatattttttatgaatagtgagacaaattttgtgggaggcttttattctccagaattattgatctttctagtatatatattgtttaattagtaaactttatttttagagcgatttggggttcacagcaaaatggagtggaaagtacagagagttcctatgtaccccttcctcacacatgcacaacctctgtattgacatcctcatttgagtgataacgtttgttatgatcaaacatcgatccattatcacccaaagtccatagtttacattagagtttactcttggtattgtacactccatggcttttgacgaatgtataattataggtatccaccactgtaatatcatacnaaataatgtgactgccttcaaaatcccctgtgctccacctccctccaacctccctcccaactcttggcaaccactggttgctttactgccttcatagttttagcttttctagaatatcatatacttggaatcatatagtatgtggcctttcacactggcttttctcacttactaatatgcatttaaggtgcctccntatatcttcatagtttcataccttatttcttcttaacactaatatcccattgtatttatgtagcatactttttttttttttttttggtaatttttttttttgagacaggttcttgttctatccccaggctggagtgcaatggcatgatcatggctcacttgcagccttgacctctggggcttaagtgaccctcccacctcagcctcctgaacagctgggactacaggtgcttgccaccatgtgtggctgattttttaaattttttgtagaatggagtcttgctatgttgcccaggctggtcttgaactcctgggttcaagcagtcctcctgcactggcctcccaaagtgctgggattacaagcatgagccaccatgcccagccagaatggatgtactacactttatccattattctactgaaggacatcttggttgcttttaagttatggcaattatgaataaagcttctacaaac

SEQ ID NO: 79768 - DNA, 1853 bp, Homo sapiens
agcggacatacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggtgtggagagtctcagtgccccctttcagtctggactgtgagctgctgctggttagacagtcttggtttctctttcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaagg

SEQ ID NO: 79769 - DNA, 541 bp, Homo sapiens
ggcaacagagtgagactctgtctcaaaaaactaataaattaataaaaataaatataaaaaattaaaattatgtgttcaaatacattaaatatatggcaatgaaaatgaggcctagcatgactgactgcattttgctcctaacccttcctaccctgtggtgacatcttccaggctaactgctttttcttatttctgcacataggccaagctatctatgggagggatttagcttacagtttaactttaaagcacagatgataataatcccttccccaaactaactcctgagaagatagagaggttgtatacacaagtaacagtgttatgctgaagatttataagagcagtgtgacctgacaaaggacgaacaattttcaccatccccttgggctcccactgcagcccatgtctgtcattgtcagacctcttcacctcaagcgcctccttcttcctcccttccctaacgtacaaggagccggaaaatcgtattaatttaagatggttcttcaggatgttacttcaccatctgttcagtttggtg

SEQ ID NO: 79770 - DNA, 487 bp, Homo sapiens
aaaggctccacaggtggcaatcccactgcaatggctaccactcccgagagtcccctagagtccgtcccaggggtgctggcatgaagtcagatgctctgttatcttcttgatcctctccctcttccccctcttctcttcctctctgctgtcatctctgctcttctcccacttcttcatttttatagtactattggtattattattaagacactgaaatacctctcatctagccatagagcaggcatttgatcttgattgaatgaatgagtgacagaatgaaggaacaacaggcctgctcaatgcaaccttctctggggactgtgtaccctgagccattatgacacagaatcagtccaaacaaggtgttaatcatattagctgtgagtgcttcgcagagtctgaagggcaaagaactccacaggtcagtttttattgtggtggagggaagagggggtagcagaaaggtccacagagaggaatttctcat

SEQ ID NO: 79771 - DNA, 361 bp, Homo sapiens
gggcacagcaggggtgggccggttcacctcctggctttgaagaaatgggttctctcctatggcatctgtgattcccaaagtcctcaatcaagcaggaagggggtgagtcgatggctcttcccaaggccttctcctcccatggacggcttctctgtccgagttctctcgccgtttctccccctttactccatcccaagaggcacttgtgagcttcaagggcatcttctaaatattacattcactcagtgccccaaagaggacagcctgttcttagaacattgctcaattctttctcctgcggtaaggattcagtttgttttattaagaactagtgtggcataagttcattctcatccaaaaa

SEQ ID NO: 79772 - DNA, 542 bp, Homo sapiens
acctcgatattcctaaaggggtggaatttttgttctaatttctaaggtacttttgcgcttagatggttttaactgtagtctctgccaacaaaggccactcataacccccagtctgaacggaccctaccctgttcaaggcccagagctgtggggcatcctagccctgctaggagaggctgcaatgctcccggcatggacgagaggggagcatggaagcccagagtccctgccactgctgctgctgcacaaagccacgacaactggttgcacaggccttgtgtctctcaatcagcagccccaagaaaggtctctgagagtgcgccattctctttctcctgagcttgctcttttgcttacctttagacgatgacttcagcgagaaagacagatgagcaaatgtcactttcatgcagatagttcacccaactgcataagtgctctcaatgggagaactttcagcacactgaagtctatttaaaaatagtgggagaagggaagttacttctcttttaaaagtgctaataataataacattaatacga

SEQ ID NO: 79773 - DNA, 631 bp, Homo sapiens
gtctcactgtattgctccgtctggtcttgaactcctggcgtcaagcagtcggcctccaaaagtgctggcattacaggcgtgagccaccagacccggccaagagaggttctgactggggagaacccatggggagttggtcgtttccggctgacacagagcggggcagccctcgcctcggctgggggagctgggggtgatgagccaagccagggagttctggggggttgggggatcatcctggggagggcgtggttagaaggcaagggccgtgagaaactctttcaggagtctgggaagggacccagcgttggaaagccacgttgaatttgctgggaggaggattccaggaagtgcgggccgtggttgtgctgtaccaccaggacgggaggtccaggcctctggggcccggaggccttggtgggagcgcggtggcggatggggagaccgtgcttgcagctgttctcggagccccggtgctgggtgctgggcggggtgggtgcccaagagtgggggcatctgaagctgaggctgcgcggggcggggtgggaggtgggtgggtcccggaggtctgtaacggctgggtccaggcctgggccgtccccgagggggccgcaccggactcattctgaat

SEQ ID NO: 79774 - DNA, 777 bp, Homo sapiens
gtggactgcaaggatcctgggcgattttctagtcctgactccatatgacagatggacacaaagagccagaaaggattttaaaacaatctatcacctatctttgaccatatggactaaaattgatatccaccaatagacactgatgcctgcaagtcaacagcataaagagtggtaaagtcagtgctgcaaaagatgaaatgtttttaatgtgctctggaggctaaccatccaagaccaagatgtcagcaggattggttcctgagggccttgaggaagaatctgttccaggactttccctttggcttgccattggccatattctctctgtgtcttctcacgtcttccctctgtatttgtttccaaatttcctcttcttataaggacagtagtcatattggaaaaaggaacaccctaataacctaattttaacttgattacctctttaaagaccttatctccaaataccatcacattctgaactattaaagattaatgcgtcaatatatgaattttgtgaggggcagggagacagaatacaaccaacccacaacacccagatacatagcgaaatcttcttcttctaggccccctgtgcctgtgtccaccacttcatcccccaattagctatatttgaaaaagtaagagggaaagaacagttggagggggaagagagagagaaagaagacagacaacttagattatgtgccctagatgttggccttacaaaacgggagcaaatcttaaccaatcattgtagcaaaacctttgtttatgaag

SEQ ID NO: 79775 - DNA, 351 bp, Homo sapiens
gcaggagggcggcagcagcagcatctgcaggtgcagctgagagtgggggacagaagaggagtaactgtcacagcgagccccaagaccctggggtgccacagctacatcctagagcactgtccatcagaactttctgcaatggtggaaagttctatgacagtcactagccacgtgggactcttacactcttgaaatgtggctggtgtatcagaggacctgaattttaaattgtattacatttcccataatcagcacggtggctcacacctgtaaccccagcactttcggaggccaaggcgggcggatcacctgaggtcaggagttcgagaccagcctggccaacatggtgaa

SEQ ID NO: 79776 - DNA, 764 bp, Homo sapiens
ttctgtactcagccagctgctgctgaggtgggaggaaaagtcctggctgggagaattgagctagtgcagcacacgtaaaaaagcgattccgatgggtcctttgaaagcttttctcttctccccttttcttctgcggagtcaaagtagaggggtgaggttggtcttcttgttactgaccctgcatttgggaaactgtgttgataaggcagatgatgaagatgatgaggatttaacggtgaacaaaacctgggtcttggccccaaaaattcatgaaggagatatcacacaaattctgaattcattgcttcaaggctatgacaataaacttcgtccagatataggagtgaggcccacagtaattgaaactgatgtttatgtaaacagcattggaccagttgatccaattaatatggaatatacaatagatataatttttgcccaaacctggtttgacagtcgtttaaaattcaatagtaccatgaaagtgcttatgcttaacagtaatatggttggaaaaatttggattcctgacactttcttcagaaactcaagaaaatctgatgctcactggataacaactcctaatcgtctgcttcgaatttggaatgatggacgagttctgtatactctaagattgacaattaatgcagaatgttatcttcagcttcataactttcccatggatgaacattcctgtccactggaattttcaagctatggataccctaaaaatgaaatttgagtataggtggagaaaaggcctc

SEQ ID NO: 79777 - DNA, 321 bp, Homo sapiens
cgtgtatgtgtttagtatcctcattgttcctagccaggcatacagtcattcactcctgagcccactgctcttggcaatatggcttctaggaattccatcacttcatcatgaatgtcatcaataactactaactgccaaattcaaaggatattttttcttttatttatttattttttttttttgaaatggagtctcactctgttgcccaggctagagtgcagtggcgtgatcctggctcactgcaaactccatctcccaagttctagtgattctcctgcctcagcctgggcgacggagggagactccatctgaagaaaaaaa

SEQ ID NO: 79778 - DNA, 1930 bp, Homo sapiens
tggcctctcagagcctcttggatccccacagggtaatgggtgtccgatgtcacgggggactctgtgatccgtgttcccctgaccctcctagtgcacaacttggccgggctcactgggctcctgcaccactgcctgtcaggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaacactcggccagacccgctggctcccaggccctgagaggacagagatgaccacatccctgctggatgcaggacccgtccaaagatgccccggggaggggtgtcagcccacgttgctggcctttggggtcaagaggagtagggatcccaggctgccctggacttagaccagtgtctgaggtggtaacagcggccgcaggccagggttggcctagacctgggatttgtggggaaagctgctggtgtgaccagctgagcacccagccaggagacctgcagccctgcgccttccagaagcaggtcccaaataaagccagtgcccacctgc

SEQ ID NO: 79779 - DNA, 1379 bp, Homo sapiens
tggcctctcagagcctcttggatccccacagggtaatgggtgtccgatgtcacgggggactctgtgatccgtgttcccctgaccctcctagtgcacaacttggccgggctcactgggctcctgcaccactgcctgtcaggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgcggtcctctacgcccgccactacaacatcccggtgatccatgccttccgccgggccgtggacgaccctggcctggtgttcaaccagcagcccacgttgctggcctttggggtcaagaggagtagggatcccaggctgccctggacttagaccagtgtctgaggtggtaacagcggccgcaggccagggttggcctagacctgggatttgtggggaaagctgctggtgtgaccagctgagcacccagccaggagacctgcagccctgcgccttccagaagcaggtcccaaataaagccagtgcccacctgc

SEQ ID NO: 79780 - DNA, 2213 bp, Homo sapiens
cgggttcaagcaattctcctccctcagactcctgagtagctgggattacagaaaccctcttgtgagcacgcctgaatttggaggatcacgtcacaagctctcaatagccacttgaactcatggccttaaagagcacaagtatcggcctttgtcttagtcaagctttcgaggagcaactcagcaattctgttaccgataatcacctaacagtttacacattcaaaaccactgggaagccacagaccaggcaccgtgggatggggaagtggagactgagaggctgctgccggggaaatatgcagtgcagacaagagggtaatgggtgtccgatgtcacgggggactctgtgatccgtgttcccctgaccctcctagtgcacaacttggccgggctcactgggctcctgcaccactgcctgtcaggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaacactcggccagacccgctggctcccaggccctgagaggacagagatgaccacatccctgctggatgcaggacccgtccaaagatgccccggggaggggtgtcagcccacgttgctggcctttggggtcaagaggagtagggatcccaggctgccctggacttagaccagtgtctgaggtggtaacagcggccgcaggccagggttggcctagacctgggatttgtggggaaagctgctggtgtgaccagctgagcacccagccaggagacctgcagccctgcgccttccagaagcaggtcccaaataaagccagtgcccacctgc

SEQ ID NO: 79781 - DNA, 2068 bp, Homo sapiens
ggggtgtcccctgggggagggccaaccccagtgtgtccactcctccccggccaaactggtcacctctgtcacctctgctgcacccggccccttcgttgtcagtatcggcctttgtcttagtcaagctttcgaggagcaactcagcaattctgttaccgataatcacctaacagtttacacattcaaaaccactgggaagccacagaccaggcaccgtgggatggggaagtggagactgagaggctgctgccggggaaatatgcagtgcagacaagaggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaacactcggccagacccgctggctcccaggccctgagaggacagagatgaccacatccctgctggatgcaggacccgtccaaagatgccccggggaggggtgtcagcccacgttgctggcctttggggtcaagaggagtagggatcccaggctgccctggacttagaccagtgtctgaggtggtaacagcggccgcaggccagggttggcctagacctgggatttgtggggaaagctgctggtgtgaccagctgagcacccagccaggagacctgcagccctgcgccttccagaagcaggtcccaaataaagccagtgcccacctgc

SEQ ID NO: 79782 - DNA, 2228 bp, Homo sapiens
ggggtgtcccctgggggagggccaaccccagtgtgtccactcctccccggccaaactggtcacctctgtcacctctgctgcacccggccccttcgttgtcagtatcggcctttgtcttagtcaagctttcgaggagcaactcagcaattctgttaccgataatcacctaacagtttacacattcaaaaccactgggaagccacagaccaggcaccgtgggatggggaagtggagactgagaggctgctgccggggaaatatgcagtgcagacaagaggttcctgctactctcacctcatcagagttgttttctaccaggaaccagccccagccccagccccagcccctgctggcagatgctccggtaccctgggctgtggcttccaggctgtgcgtgactccagggcagggctgtggccaccagggccaggacgagggtccgctgccagccccaagccccccaccagccatgagctcctccagaaaggaccacctcggcgccagcagctcagagcccctcccggtcatcattgtgggtaacggcccctctggtatctgcctgtcctacctgctctccggctacacaccctacacgaagccagatgccatccacccacaccccctgctgcagaggaagctcaccgaggccccgggggtctccatcctggaccaggacctggactacctgtccgaaggcctcgaaggccgatcccaaagccccgtggccctgctctttgatgcccttctacgcccagacacagactttgggggaaacatgaagtcggtcctcacctggaagcaccggaaggagcacgccatcccccacgtggttctgggccggaacctccccgggggagcctggcactccatcgaaggctccatggtgatcctgagccaaggccagtggatggggctcccggacctggaggtcaaggactggatgcagaagaagcgaagaggtcttcgcaacagccgggccactgccggggacatcgcccactactacagggactacgtggtcaagaagggtctggggcataactttgtgtccggtgctgtagtcacagccgtggagtgggggacccccgatcccagcagctgtggggcccaggactccagccccctcttccaggtgagcggcttcctgaccaggaaccaggcccagcagcccttctcgctgtgggcccgcaacgtggtcctcgccacaggcacgttcgacagcccggcccggctgggcatccccggggaggccctgcccttcatccaccatgagctgtctgccctggaggccgccacaagggtgggtgcggtgaccccggcctcagaccctgtcctcatcattggcgcggggctgtcagcggccgacgcggtcctctacgcccgccactacaacatcccggtgatccatgccttccgccgggccgtggacgaccctggcctggtgttcaaccagctgcccaagatgctgtaccccgagtaccacaaggtgcaccagatgatgcgggagcagtccatcctgtcgcccagcccctatgagggttaccgcagcctccccaggcaccagctgctgtgcttcaaggaagactgccaggccgtgttccaggacctcgagggtgtcgagaaggtgtttggggtctccctggtgctggtcctcatcggctcccaccccgacctctccttcctgcctggggcaggggctgactttgcagtggatcctgaccagccgctgagcgccaagaggaaccccattgacgtggaccccttcacctaccagagcacccgccaggagggcctgtacgccatggggccgctggccggggacaacttcgtgaggtttgtgcaggggggcgccttggctgtggccagctccctgctaaggaaggagaccaggaagccaccctaacactcggccagacccgctggctcccaggccctgagaggacagagatgaccacatccctgctggatgcaggacccgtccaaagatgccccggggaggggtgtcagcccacgttgctggcctttggggtcaagaggagtagggatcccaggctgccctggacttagaccagtgtctgaggtggtaacagcggccgcaggccagggttggcctagacctgggatttgtggggaaagctgctggtgtgaccagctgagcacccagccaggagacctgcagccctgcgccttccagaagcaggtcccaaataaagccagtgcccacctgc

SEQ ID NO: 79783 - DNA, 465 bp, Homo sapiens
cctccaatgtcccagtagcaaagttaaaatgaaaagagatgggtgaaattaattttaataatatattctttttttttttttaagatggagtctcgctctgtcgcccaggctgaagtgcagtgactcagtcttagctcactgcaacctccgcttcccgggttcaagcaattctcctccctcagactcctgagtagctgggattacaggtgaccgccaccatgccctgccaatttttatatttttagtagagacggagtttcaccatattggccaggccggtctcaaactcctgacctcaggtgatctgcccgcctcagccttccacggtgctgggattacaggcgtgagctaccatacccggcctaattttaataatatgttctatctatcccagtatgtcagatattttccttattttcattgcaacatgtaatccatattaaaattatgaatgagatattttac

SEQ ID NO: 79784 - DNA, 569 bp, Homo sapiens
ggggtgtcccctgggggagggccaaccccagtgtgtccactcctccccggccaaactggtcacctctgtcacctctgctgcacccggccccttcgttgtcagtatcggcctttgtcttagtcaagctttcgaggagcaactcagcaattctgttaccgataatcacctaacagtttacacattcaaaaccactgggaagccacagaccaggcaccgtgggatggggaagtggagactgagaggctgctgccggggaaatatgcagtgcagacaagaggttcctgctactctcacctcatcagagttgttttctaccaggaaccagccccagccccagccccagcccctgctggcagatgctccggtaccctgggctgtggcttccaggctgtgcgtgactccagggcagggctgtggccaccagggccaggacgagggtgaggagggggaggcatcacctcaggcacaaaattttaggggcagcaaagcactcccatcaccagaatacatactgtgtccatgcagtgttcttacacatcaaaattcatgaaaaaaaatccagaatggaa

SEQ ID NO: 79785 - DNA, 666 bp, Homo sapiens
ctttatactgagcactgtgtcaggcttttcaccaccaaagagcctcatagcaccagctgcagagaccaaaaataatgtttttttaaagctacggacgtatgattttggtgaaggttgagggtagcaatgggaaagaaagaattattaaaattggaaacctgcaattccaaagacaacaaaactacagatagactgaaaagtacaaagaagatagcaggctactgaattaaccttgggagttgggaccaggttgtcctttgtagaactggataaatcattcagacttccaggctttcagtagagagaaaaagcagttgtttctgggtatatggacaggagttaaggctgagttgacaagtcaaaacttcttgtcctcagcacccctgactttcctctatgtgtccttttgtttcttctcctttgaatagtgtgtcctgcacaggaaatggttatatttgttagcttctttcctaggtcttattggagtacaaagtaaatcttgtgtaagacataatctctgtccactaggaccccgtaatttaataggggaaataagacatgctcaagaaaggagattttatacatagagtatgaaatagtgctatggataaattataataaaaccagagatttagtttttttaaaaaatgagaatactttgatatt

SEQ ID NO: 79786 - DNA, 449 bp, Homo sapiens
tcactttttttcttctgattttaaagtaaatgaaaacacttttgtgggtccccaagattatcatgccttcagggcctgaaagacacaccaggctcttttcttattgaggattcagcgccatctggtggttctcatctcgcaagggtgcccagccacttccgctctgcagaaaaaggttcatcggcaaaattttcattcagagaatactgactaagcctaaccgctctgattactgcttgactcagatccaaactgcccgacactgggctttgaggctgtctgattggcaggagctaaagtgagacttcaagaagacaacgagagcccagtagtgaccacaaatcagctgaggaaagccaacagtccaactttttcatcagattgttagtgcagtaattttcctcatttttgtgcttgaggcaacatatcgaagagaatataaaaagaag

SEQ ID NO: 79787 - DNA, 299 bp, Homo sapiens
attcattggtcgacctgaaaataggagaaattagagatgctcttttgtatttttaagctaatgaaacaaattcagggcagataccattatgactgacttataagagactgtaaaaatgcttgtgttaaactgagtattgtgttttgaatgctaaggtaaatgaatctttagttgaggtttggaaacctttttgatacatacagatttgttgaacttgggagtagcattgggacaccagtctgttttggttgtgtttattaggatctaatatttgaagtctaaattataaaaagaatatc

SEQ ID NO: 79788 - DNA, 1151 bp, Homo sapiens
gatgggaggactgcttgaggccaggagttcaagaccaacctggccaaaaatactttttataaaaagaaaatacttcttgtagaagtgctggttcagtaatttaatagctacaagactttgtagctacaagcctttgttataaagtacagaagactactgcaacttaatcattaaatttatcatcactttccttggcagtagttgaagaatgcatctcttatgctgcttagctgttagtacatgctggttatttatgtctgactttccactattttcaatattaaataaacagttgcataacgcggagtttcaaaataatttatgattaatcaatgtttagtattccaaataaactcccaaaactcacactttaaactttaggattcaaatgtagagaaaaaacagaacagcaaccaaagactgaacctgatcatcttatagcccatcactacaactttcacaaagctaaactcaaaattaaccattatcagggttttacgaacccgaaaactaaaaattgaagtgcaattaaataattgaagtgcaaaatactatggcagaaaaaaaaccagctaattgccaaattttcctaattttttgaaaaaagctgaccacaggaaacctaaagaccattaaatgcagcatccgttctccacacgatacctaacatccctatttaaccacttttacattgtccttacacttatgagtcaactgtaaataagagcaaaaataaatgcataatctttatgttgactaagactttcacatgtactaactgtaaaatctaacagctaactcaagcttatgtatctggtagtagccacaatttagtgtcttgcttccagatttcatgttaggatgattttggcataatgtatttcccataagatctaggaaaaaaaaaaaaaaagatctctaccaactcccaaaaaagccaagaccagactgccccaagcagtcaaatggaacagcaaggaaaaccacagcaatttccttaaccaacatagtaccaaaaaagtaaaactgaattcaataaccaagaaataatttaccaactataggaaatctgggaaaaatatactaaagttatcatctcagactgccaactgtattcttcatgcatttcattaaatacatgagttttcagg

SEQ ID NO: 79789 - DNA, 647 bp, Homo sapiens
catcatgcaacctcagaagtagaagcagatggagttagaaaagctacattctagttggagacaagatattgagaaaacttgttccatacatgagctcaaatttctccacctgtaaggtggtcatattgcttgctgatttcagaaggcttaagccattggttaaaaggccttttgtgctcaataatcaagaagctgctttaaaaaataatcaagaagctgctttgattgctgataatttactagagtgacagtatccacagaaaaatttcatttatatagaaagttattatataagaaatctaaaatatgagtttgccttcaaaaacttagcctggtttaaggaagtttaaggttttaggggagtgggagtgagtgaaggaggaggttgtagaagagaatggaggaggaaattgagaaaagacaagctgaacaaaggaagaatttatctgtgcctctgagactagttcttcccgggaatcttacccctaccactggactgttttttcaaaggcaaagatcacctattgttcaactctgcatctcccacacagcatatctaccactatgtagagagtagttgcttgttgcttgataagtgtttaacaaatggtaaaacacttttttttttttggagatggagtttcatc

SEQ ID NO: 79790 - DNA, 406 bp, Homo sapiens
ctcatttctcctcagtgtaattatgtttcccctgtggtttttttccccttccttcgacaagttggaattcccactgccttggaatcccatgagggattggtcccaggacccccttcgttaccaaaatcctaaggatcctcaaaggccctgatatgaaatcgcataatatttgcatataatctgcgcacatcctcccatatactttgaatcaactctagattacttataataccgagtgcaatgtaatttttatactgttttgtttttaaatttgtattatttttattgttgtattgttatttttatttagctccaaatattttcgatctgaggttggttgaatctatggacatggaatctgtgaatatggagggccaactgtacaaataaaaatcaccacacatta

SEQ ID NO: 79791 - DNA, 293 bp, Homo sapiens
aaaacttttggcagatttctgattgccctaggaagcatcttcgccccagcaaggagcatttccttccattgaacacgcaatctacagggaattaggacatgttcttacgctgtgacttttggagcattttattttcttttttctagttcaaaattttcctggaaaataatgaagtgaactcagacaccacaggctctataattatgagatttttgtggaaaatcctggggacaatttggcttaatgcatatttatttaaatgtcataaaagtcaactcatcaaagttgtaggg

SEQ ID NO: 79792 - DNA, 1697 bp, Homo sapiens
cagctgccttgcacagcctcgcaatgagctgccacaactgctccgacccccaggtcctttgcagctccgggcagctgttcctgcagcccctctgggaccacctgaggagctgggaggccctcctacagtcgcccttcttcccggtcatcttctccatcaccacatacgtgggcttttgcctgcccttcgtggtcctggatatcctgtgctcctgggtgcccgccctgcggcgctacaagatccaccctgacttctcgccatccgcgcagcagctgctaccttgcctggggcagaccctctaccagcatgtgatgtttgtgttccccgtgacgctgctgcattgggcccgcagcccggccctcctgccccacgaagctcccgagctgctcctgctgctgcaccacatcctgttctgcctgctactcttcgacatggagttcttcgtgtggcacctgctgcaccacaaggtgccctggctgtaccgcaccttccacaaggtgcaccaccagaactcgtcctcgttcgcgctggcaacgcagtatatgagcgtctgggaactgttttctttgggcttcttcgacatgatgaacgtcacactgctcgggtgccacccgctcaccaccctgaccttccacgtggtcaacatctggctttccgtggaggaccactccggctacaacttcccttggtccactcacagactggtgcccttcgggtggtacgggggtgtggtgcaccacgacctgcatcactctcactttaactgcaacttcgctccgtactttacacactgggacaaaatactgggaacgctgcggactgcatctgtcccagcgcggtgatgtggctgcggtgggtgcccctaagactcgggactgctgtgcctttcacacttgaatgaagagaaacacctgagctatatatttttttaaagcaactaacttattgctttatgtttatctatgaaaaccatagataaaatctgatgcatttttgtaatctgacaaagtaatttacatactgtttgtgtatcaatacaattttgtgttcttggtattcttagtctagctcacctcaatagccttgaatcctgcatatgaattagacattcatcactggcatatttagaatatctctaaaaggacttgtttgtagaataaggaattttctatgtttcaaagtgttctaaaacctggctaaaagaatgtatttttgtggatggtgttgacttctgactctaaaagcaatcaaacatgtttctgctggacagtgaccaagaattatagtaccttcttatatttttttatagaactgtatatttattttgaaagaaatgttattcgtgctttaaaaaggaaaaaaaaccatgaatccaaataagtattgacttccgtttcactggtattttgactgataaaaaagggaagagggagcgggcataccaagtgtccttctaagcctccatcagcctcaccatggaaagagaggaatctgggtgtagggtgttctgttgggggttgttagagaaaaggaggcaggagaaggggctctgtttgttgtgctctagcaatttcatggaggaaaaacacgctaatattcttaatgcttttcagctgatttctgtataacaggcaaatgataggattactctgtaaagtttcatagaaagattaacgctgagcagtcaaaaaaaatat

SEQ ID NO: 79793 - DNA, 1644 bp, Homo sapiens
cagctgccttgcacagcctcgcaatgagctgccacaactgctccgacccccaggtcctttgcagctccgggcagctgttcctgcagcccctctgggaccacctgaggagctgggaggccctcctacagtcgcccttcttcccggtcatcttctccatcaccacatacgtgggcttttgcctgcccttcgtggtcctggatatcctgtgctcctgggtgcccgccctgcggcgctacaagatccaccctgacttctcgccatccgcgcagcagctgctaccttgcctggggcagaccctctaccagcatgtgatgtttgtgttccccgtgacgctgctgcattgggcccgcagcccggccctcctgccccacgaagctcccgagctgctcctgctgctgcaccacatcctgttctgcctgctactcttcgacatggagttcttcgtgtggcacctgctgcaccacaaggtgccctggctgtaccgcaccttccacaaggtgcaccaccagaactttgggcttcttcgacatgatgaacgtcacactgctcgggtgccacccgctcaccaccctgaccttccacgtggtcaacatctggctttccgtggaggaccactccggctacaacttcccttggtccactcacagactggtgcccttcgggtggtacgggggtgtggtgcaccacgacctgcatcactctcactttaactgcaacttcgctccgtactttacacactgggacaaaatactgggaacgctgcggactgcatctgtcccagcgcggtgatgtggctgcggtgggtgcccctaagactcgggactgctgtgcctttcacacttgaatgaagagaaacacctgagctatatatttttttaaagcaactaacttattgctttatgtttatctatgaaaaccatagataaaatctgatgcatttttgtaatctgacaaagtaatttacatactgtttgtgtatcaatacaattttgtgttcttggtattcttagtctagctcacctcaatagccttgaatcctgcatatgaattagacattcatcactggcatatttagaatatctctaaaaggacttgtttgtagaataaggaattttctatgtttcaaagtgttctaaaacctggctaaaagaatgtatttttgtggatggtgttgacttctgactctaaaagcaatcaaacatgtttctgctggacagtgaccaagaattatagtaccttcttatatttttttatagaactgtatatttattttgaaagaaatgttattcgtgctttaaaaaggaaaaaaaaccatgaatccaaataagtattgacttccgtttcactggtattttgactgataaaaaagggaagagggagcgggcataccaagtgtccttctaagcctccatcagcctcaccatggaaagagaggaatctgggtgtagggtgttctgttgggggttgttagagaaaaggaggcaggagaaggggctctgtttgttgtgctctagcaatttcatggaggaaaaacacgctaatattcttaatgcttttcagctgatttctgtataacaggcaaatgataggattactctgtaaagtttcatagaaagattaacgctgagcagtcaaaaaaaatat

SEQ ID NO: 79794 - DNA, 411 bp, Homo sapiens
cattgtgcttttctagtgatactgttctgaaggctggatccaacagaaattgtgtgtgtgcagagatgtgtaaataagaatgcgatattatagtcatgtgtcacataacctttcggccagtgattaactgcctacgaaattgtggtcccatatgattataacggagctgaaaaattcctattgcctagtgaagtcagatccctcctaatgttgtagtgcaaagcattcttcacgtgtttgtggtgatgctggtgtaaacgaccccactgtgctgcttctagtggtataaaggtatagcaatactgttatatatatagtacataatacttgataataaatgactgtgttactggtttatatatttactatactttctattgttattttagagtatattccttctatgtatac

SEQ ID NO: 79795 - DNA, 638 bp, Homo sapiens
ctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgca

SEQ ID NO: 79796 - DNA, 527 bp, Homo sapiens
ctccactagactgagttccttaagagaggggctatctgtgattcatctctatatccatgcattagttagtgtaagctgggctgaggtaatggactccacagtttataattgctatacaccatataagtttgtcatagaatagctgtccctcatcataatgattcagggacccaggttttttccatctgtggttctacatatcctagggcttttttgggtctctgcatctgccaaaggaaaaggaaagagagtatggaggatggaatttgcttcctaaaaactttcaccaggaaaacagcacacatcacttctgctcatattccactagccagagctcagtggttgggcctcaactagcttcaagggaggctgggaaatacggactacatgtgtcctcagggagaagagaaggatgtgggttttggtaaacagacaagacagtacagcctctagtaccatccccatggtcccacttaggtctcggggcagagtagacattcagtgagtgcttattgaggaaatggata

SEQ ID NO: 79797 - DNA, 330 bp, Homo sapiens
ttttgtgttcttttggtggtattatgtctctttgtttttcatgttttttgttgctttatgttaataatctgtgcatttgaagaagtaaggacttattccagactttgcatactgggattttctggggaagcctttcaccagtcagctcatccagagatccagagattctgagcaggtcatctggtgtggtcctctggcagacttactactggagcccttggactttgtgcctggatcagcaggtgggtgggcctggtacctgggtctctgggtctgtcgggttggacctggagccttggatcccctgttcattggatctgtaagggtagg

SEQ ID NO: 79798 - DNA, 225 bp, Homo sapiens
ctctcacttctcaccaggcacccacaaagcccccaggcagctccatctttccaatccaatcccattatcccaatctctaccccaggatcccccaaactcctcccacttcacctctgccacagacccgctcgcccccaaacttcagcctcccctcatctgccctcaccacccacagcccctcctacctagccctctcccgcgccgggcccgcgggctccccacatt

SEQ ID NO: 79799 - DNA, 470 bp, Homo sapiens
tggcttggtaatgaaagatcatagatacgaaatgaaaaatcaatgatgatgaaaaatgctttcaatttagaaatcaggagaactaggaaaagttctacagtagttccgaatcatctactatcacgttctgtgcccttgggcaactcaattaaagaagtatctagtaagtgctgtagtaggtactgggtgatctctaaggtcacggttatctctcaatttctttctattgatgccactaccattagaagactacctaaagagttctgaaggaactcaagggtgagcttgtggaaccactgccaaaaggaataggcttgatttctaccgaagaaagtacaagttggcaatgagtcccatctctaagaagggttttagaagggggcttggagccccatgcccatgagtgcctatttcagatccatgtaactttttgagataaaggataaagagtagaatcattgattgctcat

SEQ ID NO: 79800 - DNA, 356 bp, Homo sapiens
cccagctactcgggaggctgaggcaggagaatcacttgaacctgagaggtggaggtagcagtgagctgagatcacaccgctgcactccagcctgggcgacagagcaagactccctttcgaaacaaacgaaacaaaacaaaaaacaatctaaaaagttaaaaccgctcttagcctgtgggagatacaaaaacaggtggccgagtggatttgacccatgggtcctagtttgcccactcacccctggcctagccaaggtagtcatcccagggggtactgatggggcaggtggcttgagaaatttccaagggtccatttctggagagcgtggttttgtgctgtttgaacgatatcaacct

SEQ ID NO: 79801 - DNA, 481 bp, Homo sapiens
agggagggggacatgatctcatttggtcttcccaataactccctgccagaaagagacagagccccaaattgcagtgaggaagctgaggcttagaggacatccctgcacatgtctggggtgtcatatcatcatcggaggagctgggactcaaacccagctctggaacctgctctgtccccagctccatgataacattgtgtgaggtgctgggtgcagctcccaactcctccctgctcaaccatgctctgttagcctgtggtctacagagtggcttcctccagggatgtcttgatgtcttgcctttttttgtatctgaatctcttctaaactggtgcttttcaaactcagtctggagcttttagacatgaatgtgagtgttttctccatcttggtactgttgctgtcttgagagaataattctttgttttggggcagtcctttgcattgtaggatgtttaacagcatcccaggccttttccca

SEQ ID NO: 79802 - DNA, 435 bp, Homo sapiens
gaactcctcacctcaagtgatccgcccgcctcggcctccctaagtgctgggattacaggcatgagccacctcgcctggtcagattcactgtttatatttcaaagctgttcaaacatagatgtattgtaacaaaagataatgcaatgcttatgcttagaacatgcagtgcattctatttttcagttcattttgctaatgctacttttgaccacttaatcaatttacaacccattaaaggtttgagaaccacagttttaaaaatagtaatctagagacagaattgtgaattcagatgtattctgagtttttcttcctaatggccttttaaaagtgtttgtgttttgtgtctggtgaaaaacagatctcatacttggaaagcaaacatgatcctcaaatgagatttggaattcaaaaaaaattttttttttggtaaat

SEQ ID NO: 79803 - DNA, 829 bp, Homo sapiens
tgtcagttggttcctggtaggattctgggtacgaaaggagatacaccgggagctactgctcacgtttaattctgtggccttgcaccctgtgtcatgcgaatagggccaagtaggagacggaaacacaaccgactcggaaaatgccttctgtgaacttgaaaaggaaaaagaggaattaggttgaaacaacttactgggaagtcagtacttgcaaactgtaaattgggcataaaactgaaagaagaaaattcaaatttgtgggtaaaaaatcagggtgttaaaatattgaacgtgaatcaataaaaatagatttagctttatttccctccgttttggccttcagggtgtggattcatgcattcccctgcaatgctgcaaacccaatcagaacatgaggttagatcataggaaccagaaaatgaaagtgaccacaggcagggctgacatggtgcagactcacagtggatgctgtgtgacggctgagagaagcagcgggagtgtgaaaagacatgcgaatttcagtaaaataaactaggtagtaactgagtaaaattaattatctaaactgaccaaataacttattattatggataaattattactttatagaaaggacttttgaaataaaacttactttaaatatttcaatatgtcatttttaaaagaacctcagactcacaaatctaatgatttatcatttaaaaagtttcttcttttaaaaaactcaataaagtgaaaatatcccattgctttcatcatcacctgatcatctttgccttttgcttctgtttgtcacacgtagaaaaatgcagacttattttcatcactt

SEQ ID NO: 79804 - DNA, 315 bp, Homo sapiens
gcacaaccaaaaaggtggaggcaaagagagggcaaaacgggattcctaggtcactcattatacttggggccttcagatcctgctactttatcccctaggaccttgaagaaccagtgtcttgaggacagaaaaatcaaggtatcagatttgttcggtagtgctcctgcttggggctgtagggttagtgatggccaggaggtggttacagcctactgtgtttctggtgcccactgagctttgctggagcagctggaacaagtaacagtcacacaactcatgttgttatcagtgatgtccacattatcaggtggtcaa

SEQ ID NO: 79805 - DNA, 515 bp, Homo sapiens
atagcttaaaatgaaccatttaaacactttttggttatacagctcaatagcatttagatagatgcacattttgtgcagtcatcaccactatccatctccagaactttttcatcatcccaaactgaaactctgtactccttaaacagtaactccccattttctcctcctcaggctcctggtaaccactgttctacttcctgtctgtacaaatttgactgttctaattacttggtatgaatggaatcatacaatatttgccctgttgtgtttggcttattccacttagcattatgttttcaaggttcggccgtgttgtagcacatatcagaatttaattcctttttaaggctgaataatattccattttacttgtataccacattttgtttatccttttatctgccagtgaacatttaagttgtttgcaccattttggctatcaagaataacattgctataatcagtggtgctttctgttcttttaagtatatgcctagaaatagaattgctggatc

SEQ ID NO: 79806 - DNA, 916 bp, Homo sapiens
cctgttggccgagtggagactggtgtactcaaacccggatatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatgggaacaacttgaccaaaaatttgtctcagcatttagtgacccttaaattaaaaaagtttcatgagaaaaaaaaaaaagaaa

SEQ ID NO: 79807 - DNA, 591 bp, Homo sapiens
cctgtaatcccagccctttgggaggccgaggcgggaggatcacttgagcacaggagttcaagaccagcctgagcaacacggtaagaccccatctctacaaaaaaaattaaaaagttgggcaggtgtggtggtatgtgcctgtggttccacctgctcgggaggctgaggtgggaggattgggcccaggaggtcgaggctgcagtgagctatgatcgtgccactgcactccagcctgggcgacagagcaagaacctctctcaagaaaatataaaataagccttcatttatgtaatgatcaaaataagcctaatataaatgaaaatagtgaaaactagtgcaaatgttatgctaacagagagctgaactatcaaactcctttaagacttaggttagagctctaacatgtgagtgctttccatactcttccttttcactaggaaatggctttcattaagaacaagtcagtcagtggctgggcacagtgacacatgcctgtggtcccggcactttgggaggccaaggtgggtgcattgcttgagtatgggagttcgggaccagcctgggcaacgtggtgaacctgtctctctacta

SEQ ID NO: 79808 - DNA, 395 bp, Homo sapiens
ggaaattaggttggttattaacatgtatagatggaactggggtgaaaaaaaaaaggaaatgggaatggagtggaagggttgggtgggagagacacttcacagtattctttttgttttgactttggaaatgttactatttcataaacttaaaaaaatgcaaaaaaaaaatatcaaaactaggtaggaaggagaacaaaatgaaatataaccagaaaggaataaacctaacacattttgagtgaatcacaaagccaaaccaaaaaagaactaatttaagtcacttttaaacttggtgtttaactacctacactcagtctaaaaacgaaaataaggataaagaaatagtgaactctagttagttggtctttctttacagcagtatgggatggcaactg

SEQ ID NO: 79809 - DNA, 1415 bp, Homo sapiens
  misc_feature (1155)..(1157): n is a, c, g, or t
  misc_feature (1164)..(1164): n is a, c, g, or t
  misc_feature (1179)..(1179): n is a, c, g, or t
  misc_feature (1188)..(1189): n is a, c, g, or t
  misc_feature (1203)..(1205): n is a, c, g, or t
  misc_feature (1208)..(1208): n is a, c, g, or t
  misc_feature (1210)..(1210): n is a, c, g, or t
  misc_feature (1212)..(1212): n is a, c, g, or t
  misc_feature (1224)..(1224): n is a, c, g, or t
  misc_feature (1234)..(1234): n is a, c, g, or t
  misc_feature (1238)..(1238): n is a, c, g, or t
  misc_feature (1243)..(1243): n is a, c, g, or t
ttatattttgagaaacctccatactgttttggcatagatagtggctgcacaattttgcattcccacccagcatacaagggttccaattcctccatatcctcaccaacactcttttgtttttttgatagtagtcatcataacaggtgaggtgatattaaggagtacttctgcactgaggcacttgtctcaactatatttttgttgtactttcaggagactaatagatctgtggaaatttatcaaatctttgctcatttttttaacttctgagagctcttctttaatctgagtgttcctttttatgaaattgttgatgaaaaaagccgaacaagtgtaaaatattttaagagatttattctgagccaaatatgagtgaccacagcccatgacacagccctcaggaggtcctcagaacatgtgcccaaggtggctaaggtacagcttagttttatatattttagggaggcataagatatcaaatacatttaagaaacacattggtctggtttagaaaggtgggacaactcaaagcaggggcttccagactataggtaaatttaaacattttctggttgacaataggatgagtttatctgaagacctgggatcaacagaaaagaaatgttcaggttaagataaaggattgtggagaccaagtttcactgtgcagaggaagctctcagagagcagacttcagagagcaggtggtaaaatatttcttatcagacttaaaagggtacctgactgttagttgattatctcttggatctggaaaggaaggaaggaaaacaaaggggaaaggggactcattatagaatgtggatttttcccacaagagactttgcagggcaatttcaaggtatggcaaggaaatatatttttgggtaaaacatttttattttcttccttgttatgccagagtcagattggaaagtcaagatatacagggttaaataaaacccacctgatgagaatttatgatttgtagggcatgactctctaggccccttagacaggaatttgggcaagatttaacaaatcagagctgagtcctcaaaatcctattattgtttcatgaatatggtttaagaatattaattacggagggcacggtggctcatgcctgtaatcccagcactttgagaggctgaggcnnnagaatcncttgaacctgggagncagaggttnnagtgagccaagatnnngcnantncactccagcctnggtgacagantganactcngtctcaaaaaagaaaatgaaagaaaaggacaaagtaacaggaagaaaagaaaaccgtcatgtcaaagagctaatgcccttcatatatgaaaagttcttccaaattcgtaagaaaaatgttcaaaaatgatcacttcaatagaaaaataggcaaaggacatgagccaatttac

SEQ ID NO: 79810 - DNA, 451 bp, Homo sapiens
ctgtggttcacatgaatacaccccggcaactctcagctgccagagctggaatctggcaacttccctggacgggaaaggctagcccaccgcccgggaagtgaggtgcgggcaacaaaagaacacagggtggggcccagaaacggacgggacaaatggagcaacacagattttccagaaggcctcatcagcgcaagcagccagcaacaggttgcccttgttgcagaagtcacataacctaatcaactctgaatcttttctctcctccccactatctagaaacagctcaggacttaggactctgttaacttctctgtccacaagaaaaacttctctgtgctcacaggcacacacacagaatctgaggagaaagaggaaattacagaggacacccgtttactaatgatgtgggggggggcggtggtggcttcaagagcgtagtttgggagcgaag

SEQ ID NO: 79811 - DNA, 326 bp, Homo sapiens
aatgcaaataaagcggacattttttacctattagatcacttggaaagaaaaaaaaactaaaatcaatgtttcatgctacatattatctgtatatgagcagatatacacattttacaggtcaattttattgtattttggtaattgtctttcctttatcttctcttatttagtctttagatttaaaattgaaactgttgttgttgtactgaatgctaatgcagtgcaaaccaagacagtatgttttacatggcctgaatagattctttgtcactcccttaggaaaaatacgttgttcatctcatggaaataaacctttatatatagaa

SEQ ID NO: 79812 - DNA, 314 bp, Homo sapiens
gttctgtacttgcacagttggaggcatttactgctttatatttaattgtctgtttactcatcattttcctactctatactataattttaaatggcagggcattttcttgttcactcttgaattctcactgcacttgacactgggtagtcactcaataaatagttttggatggcactttgccaatctggacttttcagctcaatatacatgataaataggcaggctttaggcctggctatccatttttggccactttatcactggctaccagcatgtgaacaagtcttgcaggaatagcataagattatggcaca

SEQ ID NO: 79813 - DNA, 357 bp, Homo sapiens
ccctttacccccaagtttaaacttaaatttgtaccttaaataagattgtttaacttagtgtctgacaataaaaatatcttctgaagtcagtttatagtgttagttaataaatgaggaaatacatgatcatactataaagatggtagtaacatccggggcggcattgactgcgattttctggaatacattcagtttagcactgactaataatgaactgtaatctagctcattatacatagaattgctcataaatcactagctcacttctacatgagctgaaggctcgctcaaaaatccaagttagtgttttccaacttcccagctagcaaagggaaggaaggaaatgaaaagaaggaa

SEQ ID NO: 79814 - DNA, 481 bp, Homo sapiens
agctactcagttgggaggatcgcttaagcctgggaggtacaggctgcggtgagccatgatcatgacaccacacaccagcctggtgacagacttgttgacagaccctgtctcaaacaaaataaaaacaacaggcagtaataaaaccttctagccaccaagcctagagagttttattaatgagaatagtgagttgtgagttttgctaaatatgcggtttctttgaattccagttttatacagaaagtataaagctcttgtcaaaattttacagtaacagtaccaaaattaaaaataactaaatctctttttttttttttggattaaggtgatttgttatttcttttttttttaattatactttaagttttagggtacatgtgcacaatgtgcaggttagttacatatgtatacatgtgccatgctggtgtgctgcacccgttaactcgtcatttagcattaggtatatctcctaatgctatcc

SEQ ID NO: 79815 - DNA, 583 bp, Homo sapiens
caattttctgcgcaatgtcatccattcccatagcacctctatgcttacaaacccctaactctgtatctttaagtccttatgtctggcatggtatgcctgcaactacatattaccaacggtacacatccatttggatgtctcattaacatctacattcaacgtatctaatatcaaactcaattattttcccaaagaactcactctgcctaatctcactgtcctggttaaggactaaaaaaattggtgccattcattactttctccccctcatttttatttgccctaaccactgtgtaggttgatacttgttcagccttcaaattcttcataatcattaattcaaaaactgtctactagattttgagtgcctactaggtggatgaagatgcagaggtagaaaaactagacataatttcttgccctcatgtggtgaaggaaatgggcacaaataaaaaccacaattaattatgcaataacaatgcacagttaagtgttgtgatggagagatacagggggtgttaagttgtgtactgtaataaaaagtccttagtctgaagaaaaggaaaaccattctttatgaggg

SEQ ID NO: 79816 - DNA, 2232 bp, Homo sapiens
aggtggagatggcagtgagccaagatcgcaccattgcattctagcctgggtgatggagtaagacggtctcaataaataaatagataataaagatgaagtagacatcacctatttgtaaattataacagaaaagattaccatccagaattaaaagtacctggaagccaccacacccagacaataacaaatatttcttcaggatctattagaagcccaaatctgaggtatagtaggccttaaaatttactttgaaccttcatgccagtatttggggaagaagtaaagagaaaaggggagaaggtaggagtttaaagaacaatcctatttctggctgaaggggataaccagcaaattataaagacaaatcgctatccgtgtgttgtgctcagtgctgattcatcaaaggaaacaagcagtgtgcactggagttttcagcaagaatctcaaagaagagaagagattagttgagttgaacttttaaagctgaagtaggccaggcatggtggctcacttgaggtcgggagttcaagaccaggctggccaacatggcaaaaccccatctctgctaaaaatacaaaaaaattagccaggcatggtggcgcatgctgagtgtaatcccagctacttgggaggctgaggcaggagaatcacttgaacctgggaggtggagatggcagtgagccaagatcgcaccattgcattctagcctgggtgatggagtaagacggtctcaataaataaatagataataaagatgaagtagacatcacctatttgtaaattataacagaaaagattaccatccagaattaaaagtacctggaagccaccaagaagcacatagtttgacagcaaagtgaacaagtaaggcaggcgcagtggctcacgcctgtaatcccaacactttgggaggcagaactgggtggatcacttgagatgaggagtttgagaccagcctggccaacatggcaaaatcccgtctctactaaaaacacaaaaaaattagataggcgtgtgcctgtaatcccagctacttgggagactgaggcaggagaattgcttgaacccaggatgcagtgaaggttgcagtgagctgagatcctgctactgcactccagcctaggtgacagagcgagactccatctcaaaaaaaaaaaaaaatagtgaacaaataaaccacaaaacataggaaactaaatatgctctatatcatggataatcaagagaaattttgtttttgtttttggtagagatgaggtctcactatgttgcccagggtagtctcaaactcctgggctcaagtgatcctcccacctcagcctctcaaggtgttgggattacaggcatgagcccctgtgcctggccagaaatgtatttttataagacatacatactattaggttcattgcagcattgtttataatagtaaacaaatggtcccaatgtcaatttccatcagtaaggactctatttgctgtgtattcaaatcttttataacaggaatgcgtgtattttgtgtaagaaagaatagtaggctatggaggagggggtgatagcagcagagagaagcataaaagacctctttggcaggaaggatggcttccagaccagctaagtggagcaagcatgttttgaaggacactggctctaatagggagttagcatggggtgggtcacagaacgtatttgatcaggcaaagaggactcttgccatccaagcctgttccctcagataaatggggataattcatatgtcataagccaaataaatgagggaatgaaacatacgtaactaataataaaaagtgttaaaatttattgggcatttaactgagacaatctggttccagagcctgctctcaatcccaatgatgtgctaccttcacatcctagttacgccactgactagctttgtgactttggacaagttatttaacatcccaggatctgttttttacctgtgtaaaaatgcatatatagtacctttttcacaagcctcaaaacgaatataggccttcctcataggattattgaaagattgagttaaacattggtttagcttaggaacagcatctggcacatagtaagtgttcagtgaacgttagctattaccatcatcactattaatgtgtgctagtgactgtcctgagttacattatctaatctaatttgtaatcctctgaacatggcattcactctcctttagatgaggaaataaagctcagactggga

SEQ ID NO: 79817 - DNA, 1023 bp, Homo sapiens
  misc_feature (127)..(127): n is a, c, g, or t
ccaccagatttcatgtagaggcccaagctgcagtttcccaagagcagtttcatggggattcgcgtggaccgggtggatgtccaggaccaaggaagtgtgcctcctggttaggggtcaaggccagtcnccgctctgccagaaacggggtcggcgttgaggaagtgaggatgggagagaaacaagggggcactgaacctgcaggtgctgacgttctgaattccagactccaggcacgcgtggcgaattcggcacgagactctatttgctgtgtattcaaatcttttataacaggaatgcgtgtattttgtgtaagaaagaatagtaggctatggaggagggggtgatagcagcagagagaagcataaaagacctctttggcaggaaggatggcttccagaccagctaagtggagcaagcatgttttgaaggacactggctctaatagggagttagcatggggtgggtcacagaacgtatttgatcaggcaaagaggactcttgccatccaagcctgttccctcagataaatggggataattcatatgtcataagccaaataaatgagggaatgaaacatacgtaactaataataaaaagtgttaaaatttattgggcatttaactgagacaatctggttccagagcctgctctcaatcccaatgatgtgctaccttcacatcctagttacgccactgactagctttgtgactttggacaagttatttaacatcccaggatctgttttttacctgtgtaaaaatgcatatatagtacctttttcacaagcctcaaaacgaatataggccttcctcataggattattgaaagattgagttaaacattggtttagcttaggaacagcatctggcacatagtaagtgttcagtgaacgttagctattaccatcatcactattaatgtgtgctagtgactgtcctgagttacattatctaatctaatttgtaatcctctgaacatggcattcactctcctttagatgaggaaataaagctcagactggga

SEQ ID NO: 79818 - DNA, 581 bp, Homo sapiens
aagtgatccacccgtcttggcctcccaaagtgctgggattacaggcatgaactactgtgctcagctatttttagtctcactctatcacccaggctggaatgcagtggtgatcatagctctgacatcatgcttggctccaatatcatgcctccaacatcatccttggctaattttttttagaagttttttgtagagatggggtctcattatgttgcccaggctggtatcaaactcctgggctcaagcagtcctcccaccttggcctaccaaagtgctgggactacaggcatgggctaccatgcccagcctatcaaaatgtactttaagaaagagatcatatttatttattgtctgtatattagatgttcatttgatttcttgaacaatttgacttggttctgaaattgtttttgaaattgtgcattgtaaaacaatttagatatgtttgaccagcaggaattaaacaagccagtttaggtggaatgagaatgtcccacggtggtgaactaggtgatttgaaccaaccctcgtgctaaaaacaacttgtcttggtggttaaagtgcaaaaattttgtggagaa

SEQ ID NO: 79819 - DNA, 297 bp, Homo sapiens
cgcagcgacggaaccgggcttcttttttaaagaatcaatgtgagggaagggtgcagagccgcgttattttagggagacattgtcgcactccccctcccacgtgtaggtagcatctggggtgcgtgcgccctgttcgcagaccccatggagagacgctggcggcggcagatggggctcctttcacggttgcagccggcagtaacccgaccccgccggcgcagagactgaagaagcgcaggggacagcggcgagctgcgaacaaaagcccttggcgcggggccgaagcccaggacgcgg

SEQ ID NO: 79820 - DNA, 668 bp, Homo sapiens
agtgtggggaccaggttgctcttggatttgggggttgatatggatgccatgcaagcaggtgcctcagtgaaaactaagacgagggctagctcaagactggaaaattcagctcatggctatgactgaaccaaaacaaatctggtagttttcctaccaattaatcacttaaatttgcttgcaaattgactgaaatcagccaagggactgatttcattttggatttggtaaacagaatgaacatttgaacctatctaccgagaagattcacctctccttgccaaccacttggagccatcagtccgaacccgtcgagacataagcattccagttctacaggaactagatcattagagaaaaagcaagtcatctctctgtgagggaacagtcaacccggccaggtgagagtggtgacagctttattatataaagagggaaaaacacctttaacttgttaggtgctgggattggtcaggaggaatctgaaaccacaaactctttgttctagttgcaaccacatcattcaatggagaatgtctgtaattgggcacattagctagtaacacttcagacactgcccactacagatccttcctcttcaaggatgtcatttcattttataaggcaacccagatctgccttaagacatggtttcccatttacctggagac

SEQ ID NO: 79821 - DNA, 486 bp, Homo sapiens
tgtggagaagtctgtgaaactatgaactgggaaaagccagtttgaaaatgttgcttcaccttgctcttacatcttcttgacaattgatcttatgctgtgaaatggtagatttctgccaattattagaagactctcttagaagggggtagtaggaaatctacatagtgttacaaactagaaaagcctttaaagatagttttgttcccacatacccttttagaaactaaaagttaagactagtgatgctcttgacttacctaagatctcacgattagttaacagcaaagcaggtttctgttctttttagtttgaaacattcagcttcagcagtcaacttttgtgtgtggttactttaatgtaaaaatatttgtaaaaccttaataacattaaaaaataggtataattccaccgtcatagatagcaatgctgtgtaatagaaatacatgaaccttatatgtaattttaaattttctagtaggtacatta

SEQ ID NO: 79822 - DNA, 309 bp, Homo sapiens
tctcaaaaaaaaaaaaaaaaaaaaaaaaaagaacgtaggtgagaccctgcgccttctgcacgcctggagctggctcctggggctccccacctggcctgggacagaagtggtgggtgggctggatggagggttgagccagtccctgtagggccttagttttgagggggcctgtttgggattggaggtttgcagctctggacccccctttccagggcagctgttctagcatgggttccaggtacttaacatattgttcagactttgttattagagatacgcatttttgtaattttaataaaaacacatcta

SEQ ID NO: 79823 - DNA, 698 bp, Homo sapiens
agcagagctgtttggtagcagaattttcagtttccctatcctttccaggtcaaagggaatgatatgtgccaccatgggcccagtcgctgaggtcagttccctgagccctgtgcgtaaatgtgggctctgtgtgcaggtctttatcctgccagtcctttgatgtgcaggggattgctcctgcacctcctgagccttcagcttctttctttccaagtgctgggcattcatttcgtcttcctcttcaatgaagtctttttctctttctctttcaagaaatgtgcctttgtgtcctctgtgctagtgaagctagaccatcatttgcactgactacaaggtttagaagtctcaaccttgtctagcttgctgtttatgtgggtcctataggactttggagtcatcctccggaaacaagaactagaccatcctgggtcttgatgtgaaatcagccatttagagagacccctatctcttcttccagggcagggttgagcaaagcagcctctgtctgagaaagcttaggctgctggatgttattctgaaagatgatatttattgctcacccccagcaaagaataagagttacacagaagacaggatggcaaaattgggcagtctcccagctccaggtcaggctttctttgtggctgttgtgaagcattgcgaattctcagcgcatcagaaagacacattctaatttg

SEQ ID NO: 79824 - DNA, 305 bp, Homo sapiens
gtcttctatttaggagaaatcagacgaaactgtcatcttatatataggtcaaaaatggtttccataaccacccacctcacatgcttactgaaattcattaagtaatagatggggtggggggcgggaggtttacaggtcggcaaaggaggcaaggctagagtgatccatgtggcagtggattagagtggcaggcatcagtatgaacacatgtttagctcaatatagatacagatggctacatagagaaatatttatggatatgtgcatatacacaaattagtaagacacacattactaatcctggc

SEQ ID NO: 79825 - DNA, 368 bp, Homo sapiens
catccggggcatggacagcccccggggtgcccgcccgcgcccccgtcgccgcgtcgcgtgcggatcaccaggcagcacctggacagctccagagtcggggaagcgccatggttcctgcgcagaaaggatgcgggttggggccggcagatcctgccaggactaggggccttccctttccatcaggagcctgcaagagaaacaagaaaacattagaggggcttctgtgtagggggagggcaagttgagtctatctttcctcttgtaggtactaattaaacacctgctgtgtgcctggtactgtgcagggtgggacaggcatcatagcaactcacagtggtcccctcttcttggagcccatagtctagtag

SEQ ID NO: 79826 - DNA, 378 bp, Homo sapiens
ttatgccaacaatttataccaaaattatacctgttcacattgccaccagcaatgtatgagactacctgtttgggggaatttctgagtttttttgttaatcataactgcagtaggtagaattaaccaactgatttttttattttataaaattgatctaggattgaaggaattaagctcaagccacaggttctctgtcctgatgataatcattgtacttttgagtggcaatttgatctcatgtgtatctaaatccataaaatagcaacagaacaggaatcaattgtgtttttaaaacgcaaacctttggatggtttcattacttaatgcagactcgtgcatttaaatgggaagctaaattgaatgccataatcatattgt

SEQ ID NO: 79827 - DNA, 391 bp, Homo sapiens
atcccctaatggctctttacacaatagtcagtgggactcactattgatgcgactgtatgtcaactgtcattgaaataacctgacatagatccaaaattgaccatactccctaatactcatttcaagacaatgttagttgtaattcttggaatgctactgtatgggcttcaggggtttataaacctcctgaagttaaatgaagaattatatgtattttttcatctgaactgagaaaagatgttaaaactacagaggataacaaagaaatatatatgtacaactgcctagaattaataatatctcatcatatttgctttggatttttctatatgtaaagcaaataaaacattactgactcagtcgtctccctttcctctttcccccttcagta

SEQ ID NO: 79828 - DNA, 499 bp, Homo sapiens
aaaattttaaacttagttaaaatacacacacattgttttatattagctttttttaagttactagaaggaaacaaataaaaaatgccaaaaagtcaaagaatctcccctctcatccccagtttgatttaagcatccttgattgggcctcttatttcatgataccagtcgcacaaatttaatcattaaaataaaaatgtactgctccgccctttagattatctgcggccaaactgaactcttctctacccatccaaacttgcttattacacaaatgatacgaccagacatcctgttgtgttagagaccaatggtcacctttcctatcatttatctttgatatcctgggttgattttgccccctaaaatattgttcatctgtcagcttctctttatctccatcaccattcatcctgggccagtccaggaaagcctggattctggaatatcctcccagtcaagagtctttccaagcagctgctctgctccagtaaatgttctg

SEQ ID NO: 79829 - DNA, 467 bp, Homo sapiens
tggcttacttttgtcttttgttgagttgtaagagttctttatatattctggatacagatcatttattgaatatacagtttgcaaatattttctcattctgtgcattgtcttttcactttcttaatgtgagttctctaaatttgttcctttttcaagattgttttggctattctttcaacaattgtttctgaattgtactactgtactgcttttgttaaatttattcctaagtattttattccatttgatcctaatgtaaatgaaattgtttacttagttttatttttggattgctcattgctagtttatataaatacatttgtaggttgtatcctacaaccttgctgaatccgtcttttctagtagttttttcttgattccttgaatttctgtatacatgatgtcctctataaacaaaggtagttttatttctaaataaaatgttacaaaaactccaaaatactttt

SEQ ID NO: 79830 - DNA, 1757 bp, Homo sapiens
gccttctggcagtttctgggagctgcgaacgcgccgccccggggctcggcggccggaaacgctggcttcggagccttaggcgccgcggcctttccttgttttccgcccagtccacgccgccatggccaagtggggccaggggaacccccactggatcgtggaggagcgggaggacgggaccaacgtgaacaactggcgctggcgcggctggcggcggcctccttccgggatctggggagggccgggccgcgggagccggggctgccctggggtctgtgcggggccgcggggccagggggtcagggggccgccccccctcagctgctggacgcagggctcggccttcgcctctcggctcgggagagtccttgagtacggagaccggctaggagggttgcagctgcctctttttgaaagttgggttgggccccaagagtgacttccgacagacctttccactcccaccgtctgtggcctgagggccttcccttctcctcccgcccacccctctggatgtttcggggagttagaagggagctggattgagagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatattgcctgggaagattacattagacgatgtatatgcgaagacacttgatagctggtattgtcatgattctgattagttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaaggggaagttccaggagctcctggtgggcatcgttgtggagaatgacgcctggccgcggcgagatcacgagttgaagcaggtggaaggggaggcttcgtgcagcagccgcaaaggaaagctgattttcttctatgagtggaacatcaaactgggctggaaaggt

SEQ ID NO: 79831 - DNA, 1412 bp, Homo sapiens
gccttctggcagtttctgggagctgcgaacgcgccgccccggggctcggcggccggaaacgctggcttcggagccttaggcgccgcggcctttccttgttttccgcccagtccacgccgccatggccaagtggggccaggggaacccccactggatcgtggaggagcgggaggacgggaccaacgtgaacaactggcgctggcgcggctggcggcggcctccttccgggatctggggagggccgggccgcgggagccggggctgccctggggtctgtgcggggccgcggggccagggggtcagggggccgccccccctcagctgctggacgcagggctcggccttcgcctctcggctcgggagagtccttgagtacggagaccggctaggagggttgcagctgcctctttttgaaagttgggttgggccccaagagtgacttccgacagacctttccactcccaccgtctgtggcctgagggccttcccttctcctcccgcccacccctctggatgtttcggggagttagaagggagctggattgagagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatattgcctgggaagattacattagacgatgtatatgcgaagacacttgatagctggtattgtcatgattctgattagttcactactgctactttccctgtggcctaggctttgcctatttccagtgggcgagctagctagatcctcctcccttaaataagccagtgtttttaagacagaatactacttgcatagtggacacatattttgacctgacaggatgggcttctttggacctgggcgtctg

SEQ ID NO: 79832 - DNA, 309 bp, Homo sapiens
tctcctatttctcttttcccacttcttcccctcacccctgccccaattctaaagccatcatctttgtatttcagttgactggtatgcaatattatgaccctgttactgatttagaatatacttacgtcttcctgtttatatttgttcagccctgggtgacagagtgagagaccctgtctccaaaaacaacaacaacaacaaaaaagaaacaacttttttttgtgagtgaagcttgcttgtaataggtcatttaaaaggttaaaaatattgtgtagagtaacatctccatttcatttggaaaaaatatgt

SEQ ID NO: 79833 - DNA, 386 bp, Homo sapiens
cttttcgctttgactttgtcacatccaactcaccatgtttctcaggaatgctgaaccagtcggttcttttagccagctatgtaagagcatctgctctctttgattcgaaacacctgcttgaaaaatggagctaaagcttgggagaagcccgtcaggttgtacgtatgccccaagccaagaaaaacatttcctaggcagctggccccaggtttctgctttttgggaaccacaaaatcgctccccagattttggaggccggcacaagcttttctgttgctaagtgaaggcattttgtaacctgctcgcaccatggttccatactaacatatcaacgcaccagatggacagggtgtcattccagaataaaagagtccttcaaacccaga

SEQ ID NO: 79834 - DNA, 442 bp, Homo sapiens
catgctcccagcccctgcccctacatccttcatcctggcctccttgggctcccaagacagcgctggccaacatcacagtgacctcccacatgccagcccagtgggcacctctcagcccttcccttacatcacctggtggcagcatttgacatggtcgacccagcccccagcccccagaaccccctgtacttcctccttccctgtcatccctggttactgccacttattctcctgcccttgagtttccagggtttcatcactggcctcttctcatctgtgacctccctgggagagctcatccatctgggctgtctgctgcctgtggatgctgattattcacaatgtcctgccctagccctgatgcttctgtaccctgggccatttctccagctgcctactggacaattgactgccccacagacacctcaagcttacagtagta

SEQ ID NO: 79835 - DNA, 630 bp, Homo sapiens
ttaaataccaagcaggtataaaacaggcagctaatttgattaaggaattgaaatgaagcagtcacattaaaaaagatggtaaatctaatttttcggatgaataataatgtcttaaatttgatttccagtgtttctatgtattatataaaactaattctagttaacaaagttgaatttgctgcatatagaaatgaattaagaatattttcatacgtggatcaaaacttcacaaacccagagggcttttcctacactctgtttggagtcttttctgactgctcatattccacacagtactttgatacatgtaaagtgcaaggcaccttgctagagagcataggagctatactaagatatagagtcctgccacaaatacacacaaaataacatgaatacaaagtgtcctaaaagtcatgccaaataaaacagagcatataactgggcagagggatggagagtcacatgctggaggaggtgagcgttgacatggtcttatgggatatgaacttgagatgttgaagtagaactgagacatttctggaaaactagatgtatgaacagaagcaggaggaataggagatggtttggaaaacagcaagcagctcagtttcttgggtgatccaggagaag

SEQ ID NO: 79836 - DNA, 576 bp, Homo sapiens
aaatgccaagtggtagtggtgggcaactgtagtcccagctactcaggaggctgagataggagaattgcttgagcctgggaggcaaaggttgtggtgagtcaagatggtgtcactgcactctaggtgacagagtgagaccctgtctcaaaaagtaaataaataaataaataactgaaatatttactttatacttcagtaatgctgattgtgttttgcaaaatttatgttgttcttgtattttaaaaatataaagtttttattagctcccaaaggccatattatagacagtatatctgtgtaagaataccaccaatatattgagaacatgataaaaacttctcctactgtctctttaatgcttatttgaaaattttctcattagtctattattaatgattgtaatgtattttctatgaagttttactgttcttcattgaatagcaatgattcacaatgtcttctcttcatgagtacacacagttaaaaactgcagatatctaaagaattatttttcatagtatatctatgttgtattcagcattttatgcattaaaatctctcttattatcaattcta

SEQ ID NO: 79837 - DNA, 531 bp, Homo sapiens
tcactcagcgtaacgcccttgaaatgtatccgggttgttgcacgtatcagtagttcattccttttattctatgatatggatgtatcatagtttattcagtcattcaccttgtgaagagcatctatctgatctgattccagtttttggctattatgaataaagctactgtgagcaaacatggttctaaagctgctatgaacaatcaggttttggtgtagatgtaagttttcatttctctgaaataaatgttcacgtgtgcaattgcttggtcataaggtaatatcatttttggttttgttaagaaaacatcatacactttcccacaataccattttactatcacccagcaatgtgtgagactcggtttctctgtatccttgtgagcatttggtgttgtaactatttattttaactatgccaaaagttgtgtagcttgtgttcttaatatccattttcctaatgcctgatgatattgaacatatttccttgtgcttttttgccacttccttcaataaaaaatctcctcatttt

SEQ ID NO: 79838 - DNA, 780 bp, Homo sapiens
attttggatacttttgatatattgaatttgaactgtttgtgacatgtaactggagccatctgaaagctaattggatgtatggtttagcagctcagtagagactttgggagtgatatagcagtcttcagcttataaaggataagtccaaaggatggtggagactgggggtggaggcaggtcactctcatgcaacaaaattgcacttgcagcctgtaattacgtgctttccagatctttactgtcttattttcttttctaaagagttgtgaaaacatgacttctggcattgtctgtctttgtcattacatctgatagctataagaatatttaacaatgaattaagcaatttttacatttatactttcaatctgcgtatctgcatttttttctgctggctagggagaaagaagggtgtgccaactacattcctgcgtaaggctgtgtgaggcgctgcaccacacccctgcacactcggctcctccagtggaaacgtggagcctcagttatacaagtgaccctcactggcttgttgggtgttttagtttttaccccgtaacactgaactttgttacacagaatgtcctgtgatttcccaacacagtaggtatcttcctgagtttctcgaccggtagtttcacattggtcagaattcctctgttggccaagcttaatcttacacattgattgttttagtgacctattgatgtgaaggtggagttttgggactttactcaggtttctcagtgcggtggtagaaaatgaccttgaaagtgagacaga

SEQ ID NO: 79839 - DNA, 482 bp, Homo sapiens
gaaaaccactagcgcatcctgaatgcatcatcctatttaaaaaggaaaagcacacgtcacaaagtcaaacatcagccatttggaaacctttgcttcctgtaattagaattatgttccatctttttatgtttttgggaatttgaaataccaatttcgagatgcagaatcaaaaaaaaaaaacaaaacagcgaaacagcagcatgacacaaagaacctgggttctgatttggagtcaggttctctgggtttgagccccaactgtgccaactatgaatgcatgatttgaacatgttgcttaattttccaagtttttgcacagatatatcatctgcctccctgggagtcataaggattaagtgaaatgtttagtgcaggggtcacaaacttatttcatagagttagagtacatttttaggcttttcaagccatacagtctctatcacagctactcaactctgccactgtagcacgaaagtggccat

SEQ ID NO: 79840 - DNA, 1695 bp, Homo sapiens
  misc_feature (1)..(1): n is a, c, g, or t
  misc_feature (3)..(5): n is a, c, g, or t
ngnnngagtgtaagctgctatatgaagggatccacaagacgaataattaagggggacctctgatcaacagccagcaaggaactgaatccctcagacccacaactcacaagaaactgaagctgaagcagattcttcctcagtcaagcttcaggtgcccagctgtattggtagaggagaccaaccacaccctccacagcacagcacctggagaggaactgctgccatgaccatagaggacaccctctggatacaatgccagacttgatgtgggactgaccaacctatggaccccaggcaccaccacccagacctgctcagcacctgaaacattcacagccgtggagagagaactgttcactgctaccatccacacttctgggccccttcagcagcagggtgacaaggaagagggaaatcgacttggaaaagaggggacctctgacccaagagttcggtcaatgcatatgttggcagccagctgcacatcgcaccaaatatgaacttcaaatagaagaaagcctcatttggaagaaagctcatgcacagactgtaaatatttcagagcagattgtgtctctgtagattaacaaacagtttatttttccagtatgacaatgttgtgacaagatcagaagccagctttctcaccattaaatcaaagtcttatcaatatatggagacttttatggaaagaaacctgaaattacgcagaaatgccttccgcaagaagtggctagtatggtggcttcaagaacagtgacatttttcagtatgtccgttgttctaagacgttagtacatcacaattacctagaaaacttgttaaaacacagaagtctgggctccccctcttggccaacccccattcccagagggtttctgtttccatgggtctgaaataccacctaacgattggcatttctaacaaatttctgcatgaagctgctggtctgaggaccacactttgacaaccagtgcactacattaagctatctggagaagctgcaaatgcagatgaagaagctacaaatttttctatgtcaacaaaaattgactgatgagggtgaccttcggatcatgtttttaatgtttatgaaactggtctcattatcagaagtaaatggcttcaagaacttcagcctgaggaagaaaacatgagtcctaggcatatcaggctacaaccatgtttggaatgaatctaggtgcaaatctcagtggagaattaactgtaccaatattttaattaggattactaatgttttgttacttcctgattacaaggttctataggttttgaatgatccactgtaatcctgtttcttttccataagtcgtgtagtttttagcatgtaattatgcagaccataaggtttttcaggaatactaatatggcattagattagaaatgctatattaaaaattcttattaaatctactgatagtaaccaaaaaatagaagattcagaagaactagcaaatgtggagagaacggatgaaatggaagcagtgtgaacctagtgaatacttgccaagctgtatctcccctgaatttgtcaaaacatcatctccagcatctgagctagaccaaccctcagtgctaacattgatgtgattaaagagtctgaactgggagcagaattccttcaggtattttgttaataaaataaagctctccatctctccttaaattaaacaa

SEQ ID NO: 79841 - DNA, 643 bp, Homo sapiens
  misc_feature (1)..(1): n is a, c, g, or t
  misc_feature (3)..(5): n is a, c, g, or t
ngnnngagtgtaagctgctatatgaagggatccacaagacgaataattaagggggacctctgatcaacagccagcaaggaactgaatccctcagacccacaactcacaagaaactgaagctgaagcagattcttcctcagtcaagcttcaggtgcccagctgtattggtagaggagaccaaccacaccctccacagcacagcacctggagaggaactgctgccatgaccatagaggacaccctctggatacaatgccagacttgatgtgggactgaccaacctatggaccccaggcaccaccacccagacctgctcagcacctgaaacattcacagccgtggagagagaactgttcactgctaccatccacacttctgggccccttcagcagcagggtgacaaggaagagggaaatcgacttggaaaagaggggacctctgacccaagagttcggtcaatgcatatgttggcagccagctgcacatcgcaccaaatatgaacttcaaatagaagaaagcctcatttggaagaaagctcatgcacagactgtaaatatttcagagcagattgtgtctctgtagattaagtaagttgtgaaagtctgaacctctgccaaaattttaagaccttgacctttacaaa

SEQ ID NO: 79842 - DNA, 319 bp, Homo sapiens
attctatcctcattcaaactatcgatcaagtataaaggggagcctagattttttcttcaaatttgcaagttttcagaaagctgttgcacaatttattacaccaaaatgaaggagtaaactaaaagacagaaataataacttttcttttttaaaacttggcattttattattattattatactttaagttctgggttacatttgcagaatgtacagttttgttacataggtatacatgtgccctggttgtttgctgcacccatcaacccttcactttcattaggtatttctcctaatgttatccctcccctagcccccca

SEQ ID NO: 79843 - DNA, 542 bp, Homo sapiens
catcataagaaaatagtttcccttctgtgtttctgttacattctcaataaaaatgaaccatatagtagtcattttgaaatgataatattcttctagaaattgttaacaaatggtcgttaccaattactagatacatttttactttttttgcctgaggtgtatttttttatttttatttttattttttttttgagacggagtcttgctctgtcgcccaggctggagtgcagtggcgcaatctcggctcactgtaagctccacctcccgggttcacaccattctcctgcctcagcctcctgagtagctgggactccaggcacccgccaccacgcccggctaattttttgtatttttagtagagatggggtttcaccatgttagccaggatggtctcgatctcctgacctcgtgatccacctgcctcggcttcccaaagtgctgggattacaggcgtgagccactgcacccggccgaggtgtattttattgttgctgtttttgttgttgttgttgttttgttttgtttctttgacagggtctggc

SEQ ID NO: 79844 - DNA, 272 bp, Homo sapiens
caatcactcattcagaaaatatttgttcattgtctgctgagctccaaatacttttagtcactggggatatatcaatgaatcaatgaacaggacagaaaatataatactgtacatattaaaaataatgcacttgtatgtgtgtgtgtaaaacaagcaaaaaataaaaatatgatataatttcaggtagagacaagtgaagaacaaaaataacagcaggaatgacctttctaaggattttgacaaagaccagaatgaagcgaaagagtgagtca

SEQ ID NO: 79845 - DNA, 398 bp, Homo sapiens
gtaaatgcattttcatatggctttgcatgatgattaaagattattaaactgctggatataataaggtgccttttgctttaaggatagcttatttcattctttagaaggaagaaaataatccatatgagtaaatatagctaagtaaatagtttatttttccaggtgctatgttaaataaaagattgtgtttaaatattttgtatatattttgcttaggtaacctatatctctaatatttgtttagattctttcctaacatttttaccttacctgtaatgttgatatctgttttgtagattcagattaaactttacagaagtctggaaaatgtatttaataggtagcaaaccaatatgagttattgaaagaagcaaatgtattactttctaagagaatat

SEQ ID NO: 79846 - DNA, 493 bp, Homo sapiens
tatttatttatttagagactgagtcttgctctgtctcccagcctggagtgcaatggcacaatcttggctcactgcaacctctatctcccaggttcaagcaattctcctccctcagcctcccgagcaactgggactacaggcatgtgcaaccatgcctggctaattttttttgtatttttagtagagacaggctttcaccatgttggtcaggctggcctcgatctcctgacctcaaatgatccatcgcctcggcctcccaaagtgctgggattacaggcgtgagctgccacacccagccgtccctctcattctttaagtacttccatgttttctaaggtacaagatgttccatattattttgttatttgtcttccccagctctgaaatctgcctttccttcaaggagccttggttctttctagtgacaaattatatttagaaagaagatctgggtatttgacttgtatattgctattaattggccattgtttct

SEQ ID NO: 79847 - DNA, 714 bp, Homo sapiens
  misc_feature (12)..(12): n is a, c, g, or t
atgaggccgganccaccaagttctgggaacccacaggtgctgagaacaagagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcatttcccaaatttaggagacaatgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggaggtgcatatgcaggtttgtctcatggatatattgcctgatgccgaggattcactagaagctcaatcctgtcacccaagtagtgaacatagtaccaaataggtggttcttcaacccttgccttcctcccttcttcctcttggagtccccagtgtctattgttcctgtcttgatgtccctgtgttcccaatgtttagctcttgcctacaagtgagaatacacagtatttggttttcaaaa

SEQ ID NO: 79848 - DNA, 752 bp, Homo sapiens
  misc_feature (12)..(12): n is a, c, g, or t
atgaggccgganccaccaagttctgggaagttctttctgacacaagtaagataacatctctgccatgcccacaggtgctgagaacaagagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcatttcccaaatttaggagacaatgatgcaggcccaggaatccctaacactggaggatgtggctgtggacttcacctgggaggagtggcagttcctgagccctgctcagaaggacctgtaccgggacgtgatgttggagaactacagcaacctggtggcagtggggtatcaagccagcaaaccagatgcactctccaaattggaacgaggagaagaaacttgcacaacagaagatgaaatctactctcgaatctgttctgattcaggaggtgcatcaggaggtgcatatgcaggtttgtctcatggatatattgcctgatgccgaggattcactagaagctcaatcctgtcacccaagtagtgaacatagtaccaaataggtggttcttcaacccttgccttcctcccttcttcctcttggagtccccagtgtctattgttcctgtcttgatgtccctgtgttcccaatgtttagctcttgcctacaagtgagaatacacagtatttggttttcaaaa

SEQ ID NO: 79849 - DNA, 210 bp, Homo sapiens
tggcacaaatggctatcaagatgttaaaaaaaaaaaaaagtaaatcttgaaaccaaactcacaccatgccaaaaattaatttgagattaatgacagatttaatgtaaaaactaaaactatgatgcctctaaaagacaatgtagaatatcttcctgactttggggtaagcaaagatctcttagatcaaagagataaggcagtaaccataaa

SEQ ID NO: 79850 - DNA, 1494 bp, Homo sapiens
tctgggcttacaagacccaggggcacgtcagctccttagatgggctcagcctgacacataattcttaaacctttcctgtttaagaaacttctagaggctgtgtactctcaccaatcctcttcgagaatttgttcatgtgtatttccccattatatggatgaggctcaggataacagcatagtggctaccttctactgagttttgaggtgctaataagtatgtttgtctgaggctgcacatgtgggtggctctgtgtgtatgatccaagggacaaaatgacgatgtaggaaccagcaagaacggaatctgggctgatgcttcagtctccacctgggtgatggctagcctcccgccctccaccaccgcatcccacacgtgctgcgcactgtccccgtgtctcctggagaaccaaactggagaaaacctttctgagtatctctcatagtaccccttccttaagaagatgtggtttagagcatgtgtgcaatcctgcctctgtaattaggaaacggagcccgaggctttccattgttggttgaacccaggacagctggtgctattcacaggctgaagaactgggcagttcttacttgggtctgtcctaggatgtggaggaagttcaggactaacgctaggcagagagtatgactcggtttacccagcctaggggcctctggatgggaacactccattccaagatctcagcagagcagggcttcctggcttgaggctggaagcctttgggaagaggcccagctgggacattccctgggcacctgtcttccgctgaagggagcaaggtgccctctgggactgacagccatgaccctctgtgccatcctcaatccttgagccatatatcaagagtcctctagagccggatggtcctcaaaagtctgtccaaggaatgccaacgttcaccgggctctgagaaacgacgcaaatctctgagctggggaccacttggagaaccggcttagtaacagtcctgatcttcgcaagccagcttcttctgcatctgaggggctcctggcgcccagaggaggcagacagatgtcttctagctgagtttctaaccgcatgatgagactcagaccttccgctgcactagaaaatctgcaacagtgtccctgagtcacttctccttagtgggcagactcgtgttagatttgtggaacccagctctctgatttactccttttggaaaacccatggaatttcatgtataaggctttcatttgtattttaaggtttttctgtttgttttgagtatatacatggtgctcaatagcaacatcttagcagatgaagcagtttatgattccactccctcctgtatgacaggtagccactatactgaatcaaggtgctgaactcaaatcacaaaattctggcttaccgatacaacaaccaatacatctttgttctgtaatgtaaaatttgactccttacttttataacttattaaagttaaaatgtctgtgtttttgcaaa

SEQ ID NO: 79851 - DNA, 1424 bp, Homo sapiens
gaagtcgccggtcaccgttgggagaggctgtgtactctcaccaatcctcttcgagaatttgttcatgtgtatttccccattatatggatgaggctcaggataacagcatagtggctaccttctactgagttttgaggtgctaataagtatgtttgtctgaggctgcacatgtgggtggctctgtgtgtatgatccaagggacaaaatgacgatgtaggaaccagcaagaacggaatctgggctgatgcttcagtctccacctgggtgatggctagcctcccgccctccaccaccgcatcccacacgtgctgcgcactgtccccgtgtctcctggagaaccaaactggagaaaacctttctgagtatctctcatagtaccccttccttaagaagatgtggtttagagcatgtgtgcaatcctgcctctgtaattaggaaacggagcccgaggctttccattgttggttgaacccaggacagctggtgctattcacaggctgaagaactgggcagttcttacttgggtctgtcctaggatgtggaggaagttcaggactaacgctaggcagagagtatgactcggtttacccagcctaggggcctctggatgggaacactccattccaagatctcagcagagcagggcttcctggcttgaggctggaagcctttgggaagaggcccagctgggacattccctgggcacctgtcttccgctgaagggagcaaggtgccctctgggactgacagccatgaccctctgtgccatcctcaatccttgagccatatatcaagagtcctctagagccggatggtcctcaaaagtctgtccaaggaatgccaacgttcaccgggctctgagaaacgacgcaaatctctgagctggggaccacttggagaaccggcttagtaacagtcctgatcttcgcaagccagcttcttctgcatctgaggggctcctggcgcccagaggaggcagacagatgtcttctagctgagtttctaaccgcatgatgagactcagaccttccgctgcactagaaaatctgcaacagtgtccctgagtcacttctccttagtgggcagactcgtgttagatttgtggaacccagctctctgatttactccttttggaaaacccatggaatttcatgtataaggctttcatttgtattttaaggtttttctgtttgttttgagtatatacatggtgctcaatagcaacatcttagcagatgaagcagtttatgattccactccctcctgtatgacaggtagccactatactgaatcaaggtgctgaactcaaatcacaaaattctggcttaccgatacaacaaccaatacatctttgttctgtaatgtaaaatttgactccttacttttataacttattaaagttaaaatgtctgtgtttttgcaaa

SEQ ID NO: 79852 - DNA, 218 bp, Homo sapiens
gttagtgttgttttcatttcattaagaaaatgttggttcattgtacttattttgccatgcattttctgggcctgcatttgtgtttatgctcatgtctatatagggcaaaggatgtcagtcatgtgctatactgtaagaaagcacgttccctaataatttgaacagataagataataatgggagaaagaaatcattgcacagcatggggcatccacacc

SEQ ID NO: 79853 - DNA, 526 bp, Homo sapiens
acacacaccacagacttcaacacatccacttcatgagtgttttacaacagcacttgtctgcagccccctcaggggctggaaatgttcactcccagaaagtcaagccacccacatgcagacagcacttatcccaagacaaacctccagcaggacttcagtataggttggaaagcagtagctgccagggcaacctgagataacaaacgccctcatcgcaagttaggagcaaagctgagctgcttgcagggttcgctgagccaaagcatcaggtggcgtgacatctatgggagcatctgggaaagcagagctgccagcctgttgctagaagggttgcagttatgctttctgcatgagagaagatgtcaaatggagagcctcaaactgtggccgactgacatgcgtgcatcttttgggggaggaccatccatcttattggccatatcccccactcatattgtaattacttttttcatctttggagggggaaggcaatgaaatataacataaatctctcatacctaaaaaa

SEQ ID NO: 79854 - DNA, 809 bp, Homo sapiens
gtgcccggctcgctcatgattaggctttatggttgcttccagaaatcagaattctatatgacagtttgctgtaggatagacaaaggcataatttggcatgtgacactgacctgtaggatttgggacacctttgtttctaccactgtccacttaaataagaagagaactgacccattttggtccctgggaggactggcccacagtggaatttggtcctgctgtagataaaatagcaagatcaactgatgggagaaaataatgaacaagggccattcctactggagggtttttactttacagtggcagacaaagctagaggtgaaattttttttcccattttgattcacttgctctttctaaaactggaaatactggtagttcagaaccaaccctcctcctataatgaaaacagaattctgcttctttgtaaactttcttaaatgttagaaagaaggaaccgcatataaatattgtctaaactctacagcagggtctgatatatgtagatttggggagggggcttgattatgtcatttggtggacttctataagagcatacacaatgaggcatggacacaaacatttatttataatgaaaataaacacaactaattaccttagccttggcgagcagtccctttcttctgagctttgggattttcagtttatacaaacagcttatatagaaatgcaactgggcttcctctccctaactaaaaagtgctgtcatgctgtgctgttcccagcattcacagagactgcacaagtgccattggtttggggcaaatctgcttctaccgaaaagatga

SEQ ID NO: 79855 - DNA, 453 bp, Homo sapiens
  misc_feature (408)..(408): n is a, c, g, or t
  misc_feature (410)..(410): n is a, c, g, or t
  misc_feature (414)..(417): n is a, c, g, or t
cgccacatgaaagccctctgctcagccaccactccccgagcctggctttgcctggcctgctgcaaccaacacagccagctgccagcctggctgcccagcagagcctgaatgagaggtcacccgacactggcccgggagtacacggtggccccagcagacacctccttccgtgtctgggcagggtgtgtgcagccgaggagccaaggctgcagagcacccctaccggtccctttcaccccctggcccggcccagcaggacgtacacagacccttgcatcttggtctccgcagcgccgggtggggtggggagcctagggccggattctggcagctctctcccccagacaagggtggatgtgcagaccgctcagaaggacctcctcgccctggccgaagcgcagtccgagngncgcnnnngctccacgcgcaggaagccgtcggggtcgcggtcgc

SEQ ID NO: 79856 - DNA, 286 bp, Homo sapiens
tctcaccactgcttgtctttgtacagtacaggctagtttttcttattttattaatgttttttgcacactttcttcctttcccctgaaatttcattttgcagatggcattggcttcctactgtgcttgtcatgatcccaactttatatgacattttattcccagagcctcgtcacagtctctaaagagaacctggttcttgactatccaatagattggcttccaataatcccacccctgacaattgataattcggccagggatggactgaccaaggaagcgtcgacg

SEQ ID NO: 79857 - DNA, 382 bp, Homo sapiens
actggaagttaactgagtaaaatatttcaagaagaaagtaatcaataataattacaattataatgctgagggcttcaggtgaaataataaatacttgacatctaaatcctttccaaggaagggaaagacaagagtatatacacaacacatacacataacagcatttttgcacataattgtcatgtaatcacacagctcttcaaactgcaatggagacattagcttaagaatctgatttaacacaatatttatttctactatgctgtgctagcaagaagatcctgatttgtacatttgaaataaaataaatacttttaaaaaataaaatttttggttgtgcaattattggtagtacatacgttttgaattaaactatacttcc

SEQ ID NO: 79858 - DNA, 647 bp, Homo sapiens
aataccctgggcttggcttccagtggtggcagtcttattttgtgaagagtgatgtctgaagggtctggttggcaaggtggtgtgcattgtgagagggtagggtgtggcgaaaataaggcctggagggaggaaacttttgtatatctggtggtcttatgcctcacacaggtgagatcatcccataaggtgaacattttaccattctaataactaaccctcctgttatgggcccagagttagatccatttagaattgaactccactccaaacaaacaaagcaaggcttctttcacgctctgtcaagtgacaataaataaaataattaaacagatatccataaacctcacataagaccttttaatatgttagggcaaccactatcaattaggattgatttaagtttcttttggaaaaaaaaaactatttgggccttttctccaccataaaatcactgaataatcaaactcttgctgtctttctttctcattttttaaataaaaggggactatagttattcgataaaattacattaatatgaatattcaaagggtagctataagtacacaggagagacatccagctaaacacatctcagttacctgaggataaaagtaagaaaaatctaatttaatccaatctagtaaaag

SEQ ID NO: 79859 - DNA, 556 bp, Homo sapiens
ccctgtcgtccaggctggagtgcagtggcacgatctcggctcactgcaacctctacctcccaggttcaagcgattctcctggcccagcctcctgagtagttgggattacaggcgcgtgccaccatgcccagctaatttttgtatttttagtacagatggggtttcactgtgttggccagcctggtctcgaactcttgcccttgtgatctgcctgcctcggcctcccgaagtgctggaattacaagcgtgagccactgtgcctggcctggcttccaggtttattgctagctgtgtgaccttgggaaagcctaaacttcagttttcttatctgcagaatgaggcagataacagtctggagctacacatactaggctcagtggtgataccagctggtcattttcttccatgtattctctgcctttcatgtttccacatatctgcgataggacctccctccgtagtccagagttgaagtcttcatggcttctgtttttatttgaagtgcccccctcctcttcccattgagggtagtggagtctgtccccattaggtcacc

SEQ ID NO: 79860 - DNA, 140 bp, Homo sapiens
aactactgtatactctcctaagaactttatgtgcaccaatttatctaatcctcacaatagacttgtgtggtattgtaggtagtgatattatcctgttataggtaacaagacagaagcatgtggtgatttgctcaaggtcc

SEQ ID NO: 79861 - DNA, 926 bp, Homo sapiens
agcggatttaaaattagcaccactgaactccagcctatgcaacagagtaagcccctgcctctaaaaaagaaaaaagaaaaatttcctcagagacataggaatgcaaatcaaatttaagtaggaatatagaagatggacaaatactgtagtgttatgataggtggcagacaatcctggactaggaatcagaagctgaaattgtgacctaattctcttcctctcctagttgacttggggaagtcacttctctgaggttcatttttctggtccaaaaaataaagatactaatcttgcgtctcctaccttacggagttgtaagaacttggaatactttgaggctattacaaggtaagagaaaccgtttgttgggatttaaagtggattgggttttgagcgatcaattgctattgattgacattgagaagatgaattaactgcattcgtatggactggagcaattatttggtaatttacacttttaattagaagactgtcctgggtgaatttaaatctgcatattgggttcccagaacatcagcagtttgaattggccacattgatcatcttaaagcttcattaatttttctggaaggggtgttgggtagggagggtagatggatgggtggtgacaatctctaataaattataataagtgttaaaaatcaaatgggaggcctggtgccatggctcatgcttgtaatcccaacactttgggaggtcgaggtgggtggatcatttgaggtcaggagttcgagaccagcctggccaacatggtgaaacccagcctctactaaaaatacaaaaattagccaggcgtggtggcatgcgcctgtagtcccagctactcgggaggctcaaatgggagaatcgcttgaacttgggaggcggaggttgcaatgagccgagatcacatcactgcactccag

SEQ ID NO: 79862 - DNA, 705 bp, Homo sapiens
agcggatttaaaattagcaccactgaactccagcctatgcaacagagtaagcccctgcctctaaaaaagaaaaaagaaaaatttcctcagagacataggaatgcaaatcaaatttaagtaggaatatagaagatggacaaatactgtagtgttatgataggtggcagacaatcctggactaggaatcagaagctgaaattgtgacctaattctcttcctctcctagttgacttggggaagtcacttctctgaggttcatttttctggtccaaaaaataaagaaacaaaatcaagcatacaccaaccaaacaagagataaagaacaaaaaaacaaaaaacaaatacaaaataatataaaccagaaaaaataacaaaacattattaaaagttgattgaaaatgcaatacaattgcgaatatataattaatcaaaagttaagagaaagatatcaatcaaatcgtaaagtacaataacaatataaataatgaaaattacgtaatgaatatatcaaaagaataccaaagaataagattaataacaaccaaaatatgataacccagtagacaacagtcagtgaaatagaatagccacgaaaaaacaacaaaaagaggcagcgaaaagaaatgcaaagaataaaaaaatttaataaatttaactgcaataattaataaacaattctacaaaaaaagaagaacaaagaaaaac

SEQ ID NO: 79863 - DNA, 427 bp, Homo sapiens
ttttccttcttttttacagaaaaagtccaactgtaaaatatcatagcatataaaaccatgtttaggccatatctgttggttttatagtttgtattgaacccaaacggttttgcaatagaaaatgaatttttctttaagctgaattagcctgaagggcgtcctaatggtgagttatctggaatactcatcattgtccccatgattaacaaggatttttatgcgcacaaatttttctaagcaagagggaaagtaactaggcccttgttatttttcccttttagattcccactccctgtagagaaggtttaagtataggtaagaaggcattacaaaagtggattacaagccacaaaagggcagtagaatgttgagcttaaattccacagagtgagggttgttcagagaaggcggctaaacacatggagac

SEQ ID NO: 79864 - DNA, 326 bp, Homo sapiens
agttgacctcactgtcttccatctcaaatctagtcttatcagtatccaaccagttatccaagcaagaaaaaggagttaccctattctcctctgtttcattttgtacatccaatttattaacctgtcctgtaatgcctaaaacagccctttactgtttacaattatgtcttttccttcttatttttactgccattgctttgtttgtttgtttttgagacagcgtcttgctctgttgctaaggctggagtacggagaatgatagttcactgtagccttgaactcttgggctcaagcaatcctcccacctcagcctcccaagtagctga

SEQ ID NO: 79865 - DNA, 426 bp, Homo sapiens
ggtggggtgatgtggcgagaccatgagcgacatggtagacctttcagattaccatcatgggcaagacacggatcagggaggaaacagtgcataagaggaaagtgtgattgacattaaggaggctattgatacataacttgatgacagattgtatctagggttgtagaggaaaaggggaagagagagataaaaagtgctccagaagcacgttttggagataaaaggaagtgttccagaagcaagcactttaacaggggaggtgggtcatactgactgactcaatcaggaaatattaacacagactttttgtcagtgactctcacataagagttgctcctgtggctttttggagatgtaattggtaatggagtagcaggtctacatgggcaatgacagctatatattttgtaactccttaaaatatat

SEQ ID NO: 79866 - DNA, 648 bp, Homo sapiens
taactggatcctgagacttttcattattttaggttgacatttctatgcttttgttctggctgctccatccatcctttaagagtgaagattctccaagattctgtgcttgaactttgacctcttaatatgtccctgaagatttcatcctttcctatagctaaactaccacctgcaaaataaaaataaaatcattttcaggtcttagtcatgaattctttgtctaggccaatgtctgtaagagtttttctcatgttatcttctagaatttttatggttacaggtcttagatttaagtctttgatccatcttgatttttgtataaggtgagagatgaggatccagtttcattcttctacatgtcacttgccagttttcccagcaccatctattaaatagggtgtccattccccaatttatgtttttgtttgctttgtcaaagaccagttggctgtatgtatgtgactttatttctatgttctctattttgttttgttagtctacatgcctaattttatgccagtaccatgctttttggtaactatagccttgtagtataacttgaagtccggcaatgtgatgcctccagatttgtttcttttgcttaggattgctttggctatttgggctcttttttgattccatatgaat

SEQ ID NO: 79867 - DNA, 722 bp, Homo sapiens
agcggtggatcatgagcatattatgttctttgcatttaacctacccctaaatatttgagaaaatacatcttgggtaatataaagagttgatttagtctatgcttaatatttatttagtaatgaatattgttgctatgaaaaagttgtactacttgaactttatgtctgtaatttacatgtttaatatttttaaaactccttgcctttattcatgtatccataaattcattcaaacattcttttatttatatttactgagtaactactatgtgcaagcattggtttgtatattagaaatatggtgataagtgaaacagaatgattctttcttttgtatagattatattttgcttttctttcagggtgtgcagcttcagaaaacataaaaaattttaaaaaccagtagtctttgtcagttgccatggttcttctcttagactttgttatcgtactgaataataaaatcatgcattcagatttttatgtcagtaactgctatggtagtagagatataagtattttctgatatataatctttatagttaaatgaaggtttctgagagtatggttttaaaaatattaactttgtaatcagcaggcagaaaaatcaaatgaacaaattgttctttgtgattttgtcttataaataccttttattggtttttaaagctatataattgtcccttgaagtggtttgaacttactgcaaaatagcttggtac

SEQ ID NO: 79868 - DNA, 602 bp, Homo sapiens
cattgtaaagtcattcatttagacaaagcgataactcaaagattttttttaaggcgaaaacctttattctttgagaggagacttcatttcccaaacaataagccttaataaagacaggatgaggccaattaaacttgttctccaaaattttataaacagcctataatattaaatagtttaatcatcttgaccataagatgtaatttccataagccttttttataaccttttattaaggagtgggttaacgctccaagaaaaccttgttaatctgactcagaggcccatatgctagtcttgcatcagtgccttcgacattaatggttaatttatagagaaactaaacttattttatctctcaaaattgacccttacaatgtcacacacccatgtcttccatgatagttcctgggtcttgaggagttgaatagttttaatttctggccctgtgtctcatgaacacagtttattttggattggtatcttctacagggtctgaagataaagctttaactgctgtcagtgtttaagatttagccggacttggcatcctttttagacccaggagtctaaaccctgtaacttgatggcacaaggacttt

SEQ ID NO: 79869 - DNA, 358 bp, Homo sapiens
tactggaaacatggcagcccatacaatccaaattgtcgagaataaagatttctaagctactctctgaccaactttgagagtgtgaaaatgaagctaattgttttagtcttttctgtattgattatgttggagatctaattgaatcagatagacataatatatacataaggtgctgaaccactgggataatgcagttggacttgttgcaaacactggtataattaaggatttgttaacacttgtataataaacctctattatcaaggacttttaactaagtattaaaaatttattctcagctgcaacttgccattcaaggtctcagctaggaagcaattttcttttacaaattttctac

SEQ ID NO: 79870 - DNA, 494 bp, Homo sapiens
tcaagatgccctgagggcaaagagcagaggggtgctctctggtggcccagcagttctgccccaggggagaggtttctcttttactaccgcgaaaacccacaggacgctgcttcatcccagagccaaggataccaggaaggaaggtcagagtgaggaggtgtctgagtgtttcagatcacacagtgacatactgcttgatggcttcagaaatccttcatgagctgggagacagccccagaggtgacagtttctacaagagcagtctgaaatgccacctcccaagaaacctccatgcaacttcccaagcagaatgagtcaccccctcttctgccctttcatagccccaaccatctcgaggacaacacatcagcagcagcagccacgtagatgtttgtttctgtacctggattctaagtgcctgaaggactggacatatctggtttctaagttccaggaggactggacacatccatcacccacgtgtaaacccagca

SEQ ID NO: 79871 - DNA, 1076 bp, Homo sapiens
gtgagtcaagatcgtgccactgatctccagcctgggtgacagagcaagactccatctctaaaaaaataaataaataaataaaaagctaatgtgtagatgggaattttttctttccctcctgtgcttaatgttgtatttggggtatatttgtggattgtgtgtatgatctgtatgtgttctatatgtaatcaaacattatatttgcaaagacatcaaatgtattaacatagctttcatttgagggcatacaggataactgcagtaaagtaaatgtgcttaagaaggcctagtgctattaagttttgtcttagtaacactgttgggtattattaaaatatatattatacataggaatcctgtagcagaagataaccatcacagtttaatgttagaggccaggtgctgtcaggtgaattagctcctcctttgggaatattagaattcttctaaagtcagagaactccatttggtgagtgttccatgtaacatggggaacagctcccactttttcttaatatagctatttgacagtgagggacaggtcatacacctgacatcatttggcttttaaattaaatttctaagaaagaactgttcagttcttgctgtttctggttttcccctacttgaaaactaacatttgtaaataaaacatcttttgaaaagttcagaattatattaaataacatctttagaattaaattgagttttaaagagcttgacaatgtcctttcttgctttgccactgggttcagaaatttaaatttatatggaaatagaactctgggctgggcacagtggctcatgcctgtaatccctgcacactgagaggctgagatgggaggatcacttgagcctagcagttcaagaccagcctggccaacatagtgagacctcgtctctaccaacaacaaaaaaaagaaaattagtcaggcgtagtggcaagcgcctgtagtcccagctactcgggaggctaaggtgggaggattgcttgagcctagaaggtcgaggctgcagtgagccaccatcatgacactgaattccagagcctgggcagcagagcgagaccttatctc

SEQ ID NO: 79872 - DNA, 1007 bp, Homo sapiens
gtgagtcaagatcgtgccactgatctccagcctgggtgacagagcaagactccatctctaaaaaaataaataaataaataaaaagctaatgtgtagatgggaattttttctttccctcctgtgcttaatgttgtatttggggtatatttgtggattgtgtgtatgatctgtatgtgttctatatgtaatcaaacattatatttgcaaagacatcaaatgtattaacatagctttcatttgagggcatacaggataactgcagtaaagtaaatgtgcttaagaaggcctagtgctattaagttttgtcttagtaacactgttggatattatacataggaatcctgtagcagaagataaccatcacagtttaatgttagaggccaggtgctgtcaggtgaattagctcctcctttgggaatattagaattcttctaaagtcagagaactccatttggtgagtgttccatgtaacatggggaacagctcccactttttcttaatatagctatttgacagtgagggacaggtcatacacctgacatcatttggcttttaaattaaatttctaagaaagaactgttcagttcttgctgtttctggttttcccctacttgaaaactaacatttgtaaataaaacatcttttgagcttgacaatgtcctttcttgctttgccactgggttcagaaatttaaatttatatggaaatagaactctgggctgggcacagtggctcatgcctgtaatccctgcacactgagaggctgagatgggaggatcacttgagcctagcagttcaagaccagcctggccaacatagtgagacctcgtctctaccaacaacaaaaaaaagaaaattagtcaggcgtagtggcaagcgcctgtagtcccagctactcgggaggctaaggtgggaggattgcttgagcctagaaggtcgaggctgcagtgagccaccatcatgacactgaattccagagcctgggcagcagagcgagaccttatctc

SEQ ID NO: 79873 - DNA, 519 bp, Homo sapiens
tggattgtggttatgagcagaaagtcctgaaaccaatcccccatggatactgaaggatgactgtatatagaatctataaagcactacaaaccacaaaaatgtggccaggtgcagtggctcacgcctgtaatcccaaactgctgagattacaggcatgagccactgtgcccggccctagaaatttttaatagcaatttgatataataattttatgactgctgaatctaataaaacttgagcttatgtttttgtcttcacttttctagtaattcattttttattgaattttacaaaagtatacatctagtgatttttttttaaaaaagtccttcgcagtttgagaagcacccctcaagtactcatagatattcagaatttggcccagtacaaggcagatggcaatctggaatacaatgtaagctatggcagttaagaattttggattatggtccattcagttacttagctagaaagggtaggattagtagttcagtggtctaatccaggggtggataaact

SEQ ID NO: 79874 - DNA, 704 bp, Homo sapiens
ggaaattcctgtgggatgttgtttcctgtcttgtctgaggggaggtattatatagcctagtgattaggaggttggaatgtgagatggtggttgagagtcaggatctcttttaaaagtgatcttgagcaagttatttaaactttctaattatcagtttctttatctgtaaaatggaggtaatgggaatacttacctcaaattgctgagagaattaaatgaaataattctgcaagatagttatcacagtaaagcagtaaatgctccattcagggtaccattactattgactgccttaaaaatttaatcttctagccaggtgcgataactcatgcttgtaatctcaacacttttggaggccgaggtgagatgatcatcttgagcccgagagttcaagattaaccagagtaacatagcaggatcttgtctctatttttttaaaaaagtcacctttgtaacactggtgaatttggataaggagcaaattcagattgtatgctaattttaataatgagaaatttgatttagtatttataaacaagaagtacttttcataaggtttcatgcctatttagagttcctggttcttgttcttattaattttctgtcagactgttctatctttgtgccaattagaatagaaataaaatgggttatttactgtacctttcattgtataaatgaatatttcattttctaaggtctgc

SEQ ID NO: 79875 - DNA, 684 bp, Homo sapiens
tgagacagagtcttgagtgctctgtcacccaggctggagcgcaatggcacaatctcggctcactgcagcctccgcctcccaggttcaagggattcttgtgcctcagcctcccgagtagctgggtttacaggcgtgtgccacccacctagctaatttttgtattttagttagagacgggggttttgccatgttggccaggctggtctcgaactcctgacctcaagtgtttcacccgcctcagccccccaaagtgctgggattacaggtgtgagcaaccgcgcctggactcaagttctttttaaagcttgattaaggtataactgacatataatacacttcgcatatttgaacagtacttgatacagtttgatgtatgtatatacccttgacataatcaaaatagtgaacatatctatcatccccaaaagtttcccctgcccctttgtaatccttccccatcctctatcctgaggcaaccattgatctgcttttattatttttaaaagttagcgtattttcttatatgtattgcatatgggatttttctagaaggccacgtgcatatgcaccctccccttccattaccccagtatccgccatcaagtagtaacatgttgtaacagaaagaatcccattaagtcctagttctggtagcccggtacaaattttagattttcccccaaa

SEQ ID NO: 79876 - DNA, 419 bp, Homo sapiens
  misc_feature (53)..(53): n is a, c, g, or t
tgagcttgtagtagttattaaggagtcaataaagatatgatatagaaacttgntttccaggggaaacagaaggaggatcgtgaaaactgttgactacttagaatgatcacatggtttagtggagagagcatgattctgggttttaaaagtcatggatctcaatctcagctcctattactaactagatcttttactttggggtaagtcacttcatatctttaggccttaatttcctcatctgaaaaactggaaggcctgacttgttgagctttaagatcctcaattattatatttactaggaattcaagtttctatagatgtggttcagaattgtgacttatttattgtacatcaggtgtgattcacaagtgagcttgtagtagttattaaggagtcaataaagatatgatatagagcac

SEQ ID NO: 79877 - DNA, 2742 bp, Homo sapiens
  misc_feature (1021)..(1021): n is a, c, g, or t
  misc_feature (1026)..(1026): n is a, c, g, or t
  misc_feature (1194)..(1194): n is a, c, g, or t
gacttcttcgtagctcctctctcttccctcagagccactgtctcaagactctgcccttcttcaagagaagagcccagaagaagagagaatgactgctaggccctttatggctggattcaggccatgtaaggcatgcctgcttccccttcaccttccaccatgattgtaagtttcctgaggcctccccaggtgtgcttcctgtacagcctgtggaatgttaccaaagacgttggaagaggtggctatggacatcacctgggagaagtggaagcaaatggacactgttcagaagtccatatacagaaacatgttggaaaaatatagaaacctggttttgctagatgggaagcttgaacgtggggccaagacatcaagagtagagcagcaggacatttcaaaagaagattaatctcaaagattagagatggaagaacttgcaaagagaaagtctgtaccggaagaaatctggaaatctagaggccagtttaagaatcagcagctaaacaaggagaataatctagggcaagagatagctacctgcacaaaaattcctaccagaaaaagagacatagaatctaatgaatttgtgaaaaattttactgtaagatcaatacttgttgcagaacagatagatcctatggaagagaattgtcataaatatggtacatgttgaaagatgctcaaacaaaactcagatttaattatacaaagaaagtatgatggaaaaaaaaaaaccttgtaaatatagtgaatgtgggagaaccttcagaggccacatcactcttgttcagcatcaaataactcattgtggagagagaccctgtaaatgtactgagtgtagaaagggatttaatcagagttcccacttaagaaataatcagaaaactctttcaggagaaaagccctacaaatgcagtgagtgtgggaaggccttcagttattgcttagttcttaatcaacaccagagaattcacagtggagagaaaccttatgagggtactgaatgtggcaagacattcantcgtngtacataccttactcagcatcaaagaattcacactggtgagaagccctatacatgtcttgaatgtggaaggcttttagtcagaacacacatcttactctacatcagagaatccatactggagagaaaccttatgaatgcaatgaatgtggtaggtcctttagtcagantgcacatcttactcaacatcaaagaatgtatacaggagaaaaactctatgaatgtaatgaatgtgagaaagccttccatgatcactcagctcttattcaacatcatattgtccatactgcagagaaaccctatgatatcatgactgggaaaactttcagttactgttcagacctcattcaacatcagagaatgcacactggagagaaaccatacaaatgcaatgaatgtgggaatgcctttagtgattgttcatcccttattcagcatcaaagaactcacaccggagaagagccttatgaatgtaagcaatgtggaaaagcctttagcagaagcacataccttactcaacatcagagaagtcacgcaggagagaaacagtataaatgcaatgaatgtgagaaaactttcagcctgagttcattccttacacagcatatgagggttcagactggagaaaaaccctacaaatataatgaatatggaaaagcttttagtgactgctcaggacattttcagagaactcacactggagagaagccctgtgaatgtaatgactgtgggaaacctttcagtttctgttcagccctaattcaacataagagaattcataccagaaagaagccctgactgtaccttcataccagtaaatgcactgactgtggaaaagccttcagtgattggttagcacttgttcaacatcagataactcaacactggagaaaaaccgtataaatgtactgaatgtggaaaagccttcagttggagtacagacctcaaaaatcaccagaaaactcatactagtgaaaaatcctataaatgtaatgaatgtagaaaggcctttagttactgctctggtcttattcaatgtcaggtcattcatactatagaaaaaccttatgaatacggtaaatgtggcaaagcctttaggcagaggacagaccttaaaaaacatcagaaaatgcataccgaagagaaaccctatgaatgtaatgaatgtgggaaagcctttagccagagcacatatcttacaaaacaccaaaaaattcatagtgaagagaaatcaaatatacatactgagtgtggggaaaccattagacaaaactcttcttttttacaacaataaaaacctcacactggagagattctctgaatgccttaagaatttggttaatatggagacccttcccagggaaacagaaggaggatcgtgaaaactgttgactacttagaatgatcacatggtttagtggagagagcatgattctgggttttaaaagtcatggatctcaatctcagctcctattactaactagatcttttactttggggtaagtcacttcatatctttaggccttaatttcctcatctgaaaaactggaaggcctgacttgttgagctttaagatcctcaattattatatttactaggaattcaagtttctatagatgtggttcagaattgtgacttatttattgtacatcaggtgtgattcacaagtgagcttgtagtagttattaaggagtcaataaagatatgatatagagcac

SEQ ID NO: 79878 - DNA, 462 bp, Homo sapiens
ttggagagcccaaataaattctgctcttttttcaactagaataatgagaaaacccagctattttctcaatctcaaagcccctggatgggaaaattcatgggcaggatagagagggaaataattattcctttggcatgggaattttattttatttagtatttattaaatatgaaggactcaaaacagtgcctggcacctaataaacactaaaaagtaatgataataaagtatatattccatgtgtttaggacagaagtggcccatcccagccatttgttaaataatacttaattttctaaggatgaataaatgggatagttttattttctatgagtccccagaaaagtggtagacaattttcagtgttgtaccctacccctggcacattcaattctcttgagccccattcttcagagattcactaatatagtgctagccagtcagaaccatattcaaatcact

SEQ ID NO: 79879 - DNA, 491 bp, Homo sapiens
cccaggagccctgcatgccagtcccaattaatccactggtgctggtagataagccttcagtgttaggagctctttggggaaatcccagtgtgcacctccaagggttaaggaaaaccaaatcacgtgcaaacaatatgtaatgtgtgacttgcagatggggctcatggctgtctgccaaggttcatccatgaatcttttattgatatcttttggcttaatttagaatactattagcactatcaaattattaaaaaatccataatattttattctgaccctttggaataagtttaactcacaatgtaatttagggtaaaatgactttttagcattgttgccattgtttaagcgcaagggagtcttggagtttgttcaatactgttaatcttagttggttagctttcttaatgcctctaaaccctcacatttttacttgcttgtaatcagaatctttgacagtatcctaacttatgggctttgggtttggatgt

SEQ ID NO: 79880 - DNA, 507 bp, Homo sapiens
acattgaaggagtacaggactcctccttaatgagtaggaggtacagaggatgataaagtaagctctttaggattatcccagtttgagacttttaaacagcacatacatgcatgaggcttaaaatctggtccttgatgctagggatttcacttttgtagggacttgtctagaggtaatccatgtacccaatggaccctgtgcataatatactctgccctcattaattgtggattctgtctttgtgaatttgcttactcactaaattttatttgtaaccccaaaatcaatcttaacatttttgtggtcattcgtgaacatgcacagagcagcaaaaagtaagagtcatggatgcacacattcccagctgacttcagagttttcagctcttacactgtaaacaagttcattttcagtctgggaatgccacatggttttcgccttctgttgattttaaatggcccctatgagtagtactgatgtgtctggtgttcctaatctcaggaatac

SEQ ID NO: 79881 - DNA, 328 bp, Homo sapiens
ctcttctttttttttttttttttcttcttcctaatagagacagggtcttgctctgccacccaggctggaatgcagtggcaggatcatagctaactacagccttgaactcctgggctcaagtcaccatcccacctcagcctctcgaatagctatgagcacaggtgtgcaccatcactcccagctaatttttaataattttttatagaggctggacccagtgggtcatgcctgtaacagcactttgggacgttgaggtggaaggattgcttgagcccaggaatttgagactggcctgagttacatagtgagaccctgtctctaaaaaaaa

SEQ ID NO: 79882 - DNA, 404 bp, Homo sapiens
atggttctctaagatttatggtgggatttggcaaagctacaccctttgttttgtttcatttttctgtcaatacttactgtctgcctatcaagtaccaggtgttgtggacacagaaaggtgaaacacctgcccaaatggagttgacactacaggctgttcaagaaacggagacagccttgtaactatttatacaatccctcagcatggtaagtgctctgatgaggacaaagaagaggggaccttgctggggctggagagttagagaaggcctccaggaggagagaaggcacctgcactgaaatctaaaatcatttttgtttaagtcaaaccaaaaagatgggaagggcattccaaccaaaggcagaggaacgcacaaaagcaaaagttatgaaaataacaattac

SEQ ID NO: 79883 - DNA, 790 bp, Homo sapiens
ttttcatagatacaacagagaaatgcataatgtccagtcaatttattaaagttccaaagtcggtcgcgcgcagtggctcacgcctgtaatcccaacacttcgggaggccgaggcgtgtggatcacgaggtcaggagttggagactagcctgaccaacatggtgaaaccccgtctctactaaaaatacaaaaattagcccaggcatggtggcacgcggctgtgatccccgctactcaggcggctgaggcaggagaattgcttgaacctgggaggcagaggttgcagtgagcagagatggcgccaccgcactccagcctgggagaaagagtgagtgagactccttctcaaaaaaaaaaaaaaaaaaaaagagttgcaaagtcatactcacctttcagctcttgtcggacaattaaggggtctttgcatacttcagccctaataatttgcttcctaacatacatattgcagtggttatctaattttaaatatctttttgtttcaacacctaattttttatttagatctatctgtatgtttacaatatattttgctctatgttcattctttgatttcagaacttcaacctttctgaagcatgttttcagggtttctttttagtttctttggtggaattctgctggtggcattttgttttttgtctctaaatatgttatttagccataggttgatgaatatttttcttggttgagaatttcagaatggcattattattcttaacaaataatattgtttattttacttttcattctttcagatttcaatatgatta

SEQ ID NO: 79884 - DNA, 349 bp, Homo sapiens
aagacggagtctcactctgtctccccagactggaatgtggtggcacgatcttggctcactgcaacctccgcctcccgggttcaagcagttctgcctcagcctcccgagtagccaccacacccagcctcattggcatcttagtcatcattcttcgtgacttcttccttttcttagcttctcctctcttctgatttccttttcagctttctgactttttttctcagtctccttactattttcccttattaattcatgcagcaaatatttgagcacctgctgtgggccagagtacaatcagccctccgtatctgcgcattctgcatctgcggattcaaccaactgtagatag

SEQ ID NO: 79885 - DNA, 429 bp, Homo sapiens
ttttgaatagtgcaagttcaatccctaaaacaaaaagcaagatcttttttcccctaaataatgtgctctccggcttcacctctcatcctgaggaacatgaaagagaacgtaaaagaggtgacccaaatcacagagtgcctttgataggagaaattcagctgttttgaacactcacaatcaaaggaagtggtttccctaattacatgaactatgtgaaatctctcagaatagctcttccaccccaggattccttgcactttagaagtttgcataaaagctcacatagagaatcagatgcaaagtgtttgattcagattttattaggcagaagagtgcccacatccatcctgcagtttgccagctgcttaggttaggaccactatacctggttttgatgtggttgtctttcaaacctgcaacattaagatc

SEQ ID NO: 79886 - DNA, 2604 bp, Homo sapiens
cctctggtttaaagcaaaatcgcatctggggccagctcaactgcagcaagtctggtcagattcaaccctggacgatattagaatgatattagttttggaaggaggggatggagatcttccccttctaatactcaattttgttttggtatttgattgtcacaactagaggatataacaggaggtcagtttaaaaaatagcaaacagtctaaaaatgaaaactattcaatttagtgatggcttataaaagacactccaacttgtcttgcccaaactcccttcttcacagagccagggggctagatttcttgccactttttttctgaaaggcaaatgcatgacttttattcttttgggtctcagtgtgtttcttgaactgtgtgacttcaatatctgtgacaagtttttattttcccttagttgtatgtgaagaatttattctatagtcgtgatcatgtagtcctccattgtttggaagtgcagaccatggattcctatgcagcagatgggggttgtctgtttgtgcacttttttcctaagctgctgaaattcctccgatgtgaatgggccatagtaatctttgcctcctgcgtgactgtaagcatggcctccagtggatcagagaaagcagctcagtgattgttctcatggccaaaaataaagcacaagggttaccggaattgaatgagccctgttcagggcagcacggggcatctgcaccccagctgggcagcatgatccttgtattcaactatactcttctggcagtagttggtggcaagcattcgcgtgcctctgtcacaaccatacgtagaaacacattaggtatgtctggaaagctacaaatcccacatccaagcacagtaccgtctgcttcatctgattaacacacacacaagaaagaaaaattacacccacagaaaactgagtatgtattgtagaaatgtagaggaaaaataaaaatattttttcaaatgtaattacttttaatatatgcttgtggaaggtctaatacaatgtatgctgtctctgtaatttttgctgtaaataactggagacggtgagtacactgatttttctatgtctctgtttaagcataagactttgtaacaatttttttagagggggaaaatcaacaaagagcaaatatgtacttgcttcctttctgcgtgttatgtacttctcagttttttaatggaaactggttgtaacagtttaagcatcttgacgggtcattggtgttaagtgtatgcttctttttgtaatatgactgagaaagggacagggctgtcaattaaatctgctccaaagaatttgtattgaagattggcctaagacctgcaaactccatctataactagaaaatacgaaaaaggaaaattaaaaaaaaaagttgcctgagttaagtcatctttccttgtagcaaatggctttgtccaaatcctttctgcatggaatagcttaaggaaaacaaactccgctttctgatgaacaagatatttttgtacacatttatttcttgttaataacctgaggtcagaccactcatttgctgaagccataactgaccttcaccaaataaatgttgtaaagaacctaggggagggttggggagagactgagagggaggaaaatccaaggtgtcatgagctatagcaacacaggcaggagcaagttgttgaaactgatgcttttcctgcatcccaaatatgactttaaaaggctagtattttatgatgatcgatttataatgataaaaagatatttagatttaaatgagacattccaatatttttgaaatccctaacaatgcttccttgcttttaggattgagagaaatgattttcatatacttccaacattcagagatttaatgtttttaccttagctccagcctacgcttgtaaagtgaagagtgattctaagtcccgtgaaaccgtgggctgcctggggcttggctgtgcccactaacctactgcgcctggggggcagcatgggaggggtacagtttgcatctcattagcatgcacaccactgttggcaatgcataaaagttgcattgccacaagtatgtaaaataaaaatattcactctaaaaagaataataattctacttttttaaaagaataatgtctcttatagtcaccattgatttttctggagtttaattacattattaccatgtattcttattggcctgtagaggaaaaaggcaaaccacaaataaacccagtgacatatatagttttaaaatctacaattttctgatctctctctccttgtttaatatataagccctaatttctgtgtatgtgagtaaaactgcagcctgagtcatttaggaagtaagtattgagtttttttaatcataaatatactagaataaaacagcactccctaacaattaaaaaagagttttatattactttagaatgtaataggtttttgtccttattttatgtcctgtaaattattagttcaatactgttagcattcccggataatgcacacatgatttctgaatgttttctgtaaatgacaatcaatgtttatgaagttccctcctttaatgctgaacaaaattaaaagaagaaaaagaaaaaaaa

SEQ ID NO: 79887 - DNA, 1667 bp, Homo sapiens
cctctggtttaaagcaaaatcgcatctggggccagctcaactgcagcaagtctggtcagattcaaccctggacgatattagaatgatattagttttggaaggaggggatggagatcttccccttctaatactcaattttgttttggtatttgattgtcacaactagaggatataacaggaggtcagtttaaaaaatagcaaacagtctaaaaatgaaaactattcaatttagtgatggcttataaaagacactccaacttgtcttgcccaaactcccttcttcacagagccagggggctagatttcttgccactttttttctgaaaggcaaatgcatgacttttattcttttgggtctcagtgtgtttcttgaactgtgtgacttcaatatctgtgacaagtttttattttcccttagttgtatgtgaagaatttattctatagtcgtgatcatgtagtcctccattgtttggaagtgcagaccatggattcctatgcagcagatgggggttgtctgtttgtgcacttttttcctaagctgctgaaattcctccgatgtgaatgggccatagtaatctttgcctcctgcgtgactgtaagcatggcctccagtggatcagagaaagcagctcagtgattgttctcatggccaaaaataaagcacaagggttaccggaattgaatgagccctgttcagggcagcacggggcatctgcaccccagctgggcagcatgatccttgtattcaactatactcttctggcagtagttggtggcaagcattcgcgtgcctctgtcacaaccatacgtagaaacacattaggtatgtctggaaagctacaaatcccacatccaagcacagtaccgtctgcttcatctgattaacacacacacaagaaagaaaaattacacccacagaaaactgagtatgtattgtagaaatgtagaggaaaaataaaaatattttttcaaatgtaattacttttaatatatgcttgtggaaggtctaatacaatgtatgctgtctctgtaatttttgctgtaaataactggagacggtgagtacactgatttttctatgtctctgtttaagcataagactttgtaacaatttttttagagggggaaaatcaacaaagagcaaatatgtacttgcttcctttctgcgtgttatgtacttctcagttttttaatggaaactggttgtaacagtttaagcatcttgacgggtcattggtgttaagtgtatgcttctttttgtaatatgactgagaaagggacagggctgtcaattaaatctgctccaaagaatttgtattgaagattggcctaagacctgcaaactccatctataactagaaaatacgaaaaaggaaaattaaaaaaaaaagttgcctgagttaagtcatctttccttgtagcaaatggctttgtccaaatcctttctgcatggaatagcttaaggaaaacaaactccgctttctgatgaacaagatatttttgtacacatttatttcttgttaataacctgaggtcagaccactcatttgctgaagccataactgaccttcaccaaataaatgttgtaaagaacctaggggagggttgggctcagggagaaaccaaggacaatgctaggtgttcatcggtcgccagtttatcctcaa

SEQ ID NO: 79888 - DNA, 362 bp, Homo sapiens
agagggggtttcgccatgttgcccgggctggtcttgaaatcctgaactcaagtgatacgcctgcctcagcctcccaaagtgctggaattacaggcatgagccaccacaccagtcctagcttaaaatatctttgaaaagaatattttcaagtatgttagcaagtgtttctgaatggaatatttgtgcaaagtatatcagcaaaacgaagtcacagtcttagccacattggacctcattgtcaatgaagagaaagtaaaagtcatcagtgtcctctaccaattgcaaaaataacttaaaatattttcaatgtcaaattaattgtaatttatattaagcaattaattacaattttttgttgcaat

SEQ ID NO: 79889 - DNA, 485 bp, Homo sapiens
taaaatgtgttgtattagattttttcctaaagataggtggcaaggcaacctttccttggtcaagtttattagaaacctatttcagacattgtagagaatgttgtatgtttatatagcattcctggaaagccatctgaaaatagtaatcaaaattaatatatatggcctttgatctcacagtcccacttctgataatctatcccatagaactaaaagtactgattagtaaaactgtgtgtgtgtatatatatgtatatatatgtatgtgtctgtgtgtgtatgtatatatatgtgtatgtctatatatataaatatatttatagcatcatagtatattgcatctaaacattggaaacaggccaggtgcagtggtctcacatctgtaatcccagcactttgggaggccaaggtgggaggattgcttgagcccaagagtttgagaccagtgtgggcaacatagtgagacaccattacttttttcttaa

SEQ ID NO: 79890 - DNA, 261 bp, Homo sapiens
cagggaacagcttacttccttgatgacactgggagtatttgataaaataccccatgattctataagccagactcatgtctgacatctccacattgctcttaaactccatggctacaaagaacagaatggaaaaggagaggagggagagccatccctgacacctgcctctctcaagtggtcccaggtccccactgcagccgctgttaccaaggtaccaaagctgtggctgaaatgaacaggcaatatggcaagtggaaaagg

SEQ ID NO: 79891 - DNA, 1120 bp, Homo sapiens
tggggttttgccacgttggccaagctggtctcaaactcctgaactcaagtaatttgcctgcttcggcctcccagagtcctgggattacagtcgtgagccatcgcgcctggccgtgatagaaactttcagctgaggagtctatatgccatactactctatgtggcatctttaggtctctgtgaaatcatgttgatgtaattgattaacaaaaataatttagaaaatacgtcaggcacagttgatggcttctcaatatctgctttgcatttttaaacaaatcaagaatgtaattttaacttttgcttatggtcattcttatgactacacggaaagggatggaatcatacttacttgtcttatacatggactgtttttagttaacaataacgtaactacacaaaggaaaggaaatgtttacattttaaaaaattactgtcaattacatctggtatttttcagattatgcataaaataatatgagtttgactattgtatcagaatattttaatcaaatcctgcaatttatattaacttaaaaaaacatctggtaaagactgggtgtggcagctcacacctgtaatcccagcactttgggaggccgaggctggatggatgattgcttgagcgcaggagttctagaccagcctgggcaatacagggagaccctgtctctatttcaaaaataaataaataggccccggtgtgtgatgttccccttcctgtgtccatgtgttctcaaaaaaaattaaaaaataaaaataaaaataaataaataaataaccagtaaagatgtactgtttctactgcagtttataatatttcatttattaagaaagatatcatctcagctttcaaattcaacatagccctcaatttatgacataagttttatacttagtattttataatttcttaattttgttataaacttgaaaatgtagaatatggggtccaaaatctgttgaacatttgttcagctagttaggtttcaacattaatcatatacattaatagtatctttatgtaaggatatgtgaagggtgtttttctttataagaaaattagtttaatcaggtgagctgatacttaggattatacatatatctatgataaaattgaa

SEQ ID NO: 79892 - DNA, 594 bp, Homo sapiens
cccatttcaagaagagtccaggcgtacggcttcactgatgtcttgggttgatccctatctcatcaatgtcaggggacagcctgagtcccgcacagggacttcggggaagcctagaggaaaggtggctgtgggagaaggagctacaaacctccctccagctttctccctcagagtaattgtcttacttttgttcccataaaaatctaggctcctgaggttattctcaatggaaaatatggtgtaagcgaatactcggtatgaatttcaatgaaatcatgttgtacttctgatcttacagggaaatattaagatccatgttacatagaaatgcactaggcattgctgtctccccatgaaacatgacttaagcacaggatgtttggcaacagctttataacataagtcaaaataaaattggtttccatgcctcccatatagttacataaaaatcataagtggcagaaatgtccatgttttacatttatgctttatgaagtattttgtgctttgtcctattatgtaacaacccagaaagaatatatgcaccggtcaatttttctccacttctgcatacttattttgtaccctttaaaa

SEQ ID NO: 79893 - DNA, 613 bp, Homo sapiens
gattaaggttctgataatagttgttaatggtagtatctcacatagcaaggatatgtgtatgcattcacgatttcttatagagaatcttctctgagaaatgtctttgatccaccaacttcaagttcctggagtgacctaattttgctgtttcctagtgtgcctttagaagggtacgttgttggagcaatctaggttatcctgtggtttctttgcagagagctcaagagtaccatattatacaaagcagccactttttcttaatttttgtgtaggtgacagtgacccctagactggaggttcctgggaggtaaaggacctgtcgttctagtctctgcaagaaaaatattgcctaaagttatcacaaacatttacacaattggataccttaaggttatgttatggaattttaccttaatgtttctgcttattgcagaaaataaagtaacaaaggtagaaataaaagaatataaaagatgctcaatcccagaaataaatattaattctgtaatgcgcattttaacattcttgatgttaggtaattttatggttttcaattttagaatttagcaaaacttccttgagaaagcacttaaaaattaaatttattgtttac

SEQ ID NO: 79894 - DNA, 912 bp, Homo sapiens
cgcgacgcgcgcactccctcgcgcccacccgcgcgcccggccgcgtcgcccccagcccgttggtccccggactgcggaccccgcccccgacgggggccaggtaacccgcttccgagtgtgccacggcgacccccatctcccctccccgtgtcataataaatctcacgttttctgccggctggaggcttggagcggtgaggtgacgttcatttcggccgcgtgaagttttctttcaaactgggattggtggggaggccgggggaagggagcggggcggcgatcttggcgccctgcgcggagtccgggagccgcgtcccggccgagtcggggagtgtgcgtggagcctcccacctactggtctccgccggcaactctgcggccccatttcggaaagcgcaccgcattgaccgggacctgaagcgggataagaggggtcctggggaatagactgagaaagacattcatgtctgagatgaagctcaactattactattttgaaagtgctttaacagtgcaagtttaaaaactaaagtgttgacttgctttttctcccccggggcatgtgccacgtcttccaaagtcaaaggaacggatgagtacaaaaagttgctacccttgaagtgttacctatcactatcaaccacagcttgtttatttggaaagaacttaagtgaaccgtcaagagaaaaacaaatgcatattctttctacaaatagtagcatttagtatctttcctgaccacatttgcgaaaagagggaatagagacttctataattaaagggaaaaggaaaatgaaaggagctgaaaatagtgaactgtgtagtctggatggctgaaatttgaaaacacatgaaattatcaggactgccaaacggtgttcctgagaaaccatatcacagattgtgaagaaa

SEQ ID NO: 79895 - DNA, 401 bp, Homo sapiens
gtcattcaccctaatccctctttcaccttcacagaactttcacactccaatgtacttgctgtttgtagatgctcctataaacagaaagctctgggagacaggtgtcttgttattcttgctctctgtcatatctctgggcctatcacaagtactcaaagcatagaagttcaataaatatgtgttcaatgtaagaaatgatcagtgattctcaagctgcagtggcgtcaggatcacctagacagcctgttagcacggatcactgggccccacccccagagtttcaggtctggtctggggtggggcccaataatctgtattcctaaaagtcccaagcaatgctggtgctgttcgtccaggaaccatgcttaaagaaccactggaatagactggcgaacaaaagg

SEQ ID NO: 79896 - DNA, 794 bp, Homo sapiens
ggctctgtgagacaggccctccactctcctgtagatcctgttgtaagtgatgcagaagccagagagaaggttgctctccatcggaaacatgaggagtttcggagacctccctaaaatatttggcctgaaagggtttgaagccaggaggagagatgcagtcttaggagaaacgtttcatgagctgtagcaggtaccctatcagtctttctcagaataaagaagcctatattcataagaatgctgattcttaaagggctagaaaggccagttgaagaaggccagtctgtagagatgcctgggaattctttgatctttttggaggctaaaggaagtaaaattctgctatggaaattgtcctattatatttctgctttcaagaagtggctacaagattatgaggttttgcaatgttgccctcctagtcctgtgtacattgctgtaaagactcccaggcatggaggccatcactggcactgttcctctcagcagttatttgggtgtgaagttcctcactcctgcaagactcagcctgaaggagcatgtctacatgacccacctgcacaatctccccacttgtcagtaacagctgtgaaatctgcccctgttgtctttagaaactgaaagatggaaaagatctcagatgctgtgacccccatgtaacagatggaggaattgaatccaagagatgaagtgaccactttgcctaaaatcaaatagccatgtagcagccgagctaaaacaaacattcagtcctcctgaatcctaactcagtgattttctcttaatatcatata

SEQ ID NO: 79897 - DNA, 387 bp, Homo sapiens
tggacttgagtgttgagctgaccatatgtggtctccaagcctgaccctctgcaagaacaggagcaggaaaagaagcagggggtggtgctcttccttgcccttcatgctcatttgtgttcccagctcacgtatgttaaggatatctattggcctaactagacacttgcacattattcttggctacattttttaaagtcacaggggttttaatttagttaatcttgttttgtctggttttactttgtttttaaacaccagagaggaaaaagaaagctcttagggtgaaaataccaattataaaatgagtgaatcctagagtttaattcctttacaagtttaatcattttacaagctttgatttttcccatgggcagatggaagttttgg

SEQ ID NO: 79898 - DNA, 531 bp, Homo sapiens
gtgtgtaagccatgttttcttgttcacgccagccatgggaggtgataatagcctgggtaacaatttcagtcatacttgtccaggagcctgcttccttgaaagtgactgatgttccggtgttcctttctttcccattgggtcttggacacctgattgttaccatggtgtttgtccactgctgctatggtcttgttgatgctgctccaaatatgtagctgtgttttctggatacataatttttatttaaagcttattcctggacacattttgtccatttttgaaaagatctaaactaatttgactagtagaattaggctaacaatacatggttcaaggaaaaatactgccttttgtaataaaagtttcttcttgcctagtgtctcattggtctgaatataatggctgtcttagacccggcatcctggcgcctgtcttcaactctagttctgccgtatgtgactttaggcaagtgtgtgtgtttcggaacttcattttctacattatataaaatggaattggataaaagctaca

SEQ ID NO: 79899 - DNA, 1034 bp, Homo sapiens
gcgtccgcttaaccaccgaccgggtcgcctccccgcgtttgggaccccccgtgcgcggtgtccgaactggcattctcctgggccgcccccacagatgttaaaattttctgggccggccccacaatttttttttttttttttttttttgccaaattgtatccattttgtttttttttctctcttgaaatctcagagaaagagattgttacatccttggttttaaggtgttgggttcctttcctgcccctgaaatgtgggctctgccagtgccttttctgcttttctctgggttgtcactagagggcagcatacgcccgtgtttagaagtcagagctgcttgatttacggacagagaaccgagggcgcacactgcctccttgggctttaggagcacaaaattgtaatacccacgggatatctttattttactagcaataggatctcaataaggtaggaaaactgatatgcaggccgacttcttactagaaatggcaaacttcattgaattaaggattccagaatcaaattgctgttagccatgtgaacgttaccatctcacattgaaacaccggaggcgaggctcctgttctagctcctcttttatattacttaatgtgacttgactaaatttctgtgaagttgaggataagcaaatatttgtaccattttttatagaaataaatacaactgctgaagatgcccagcgaagaagaagaatatgaactgtcctgtgctgagcccaggccctttgcacatggcctccattctccacccccgcctaacaaggtgcctgtagtcagttttgttttaagacaaggacactaaagccggccgagggacccacccaaggccacacagggaggcggcctcaggatcatgggcagctccgtctggttccttcccaggctccgggccatatcatcagcaccctcccctcatcctgccccgctgctcatcgctcgcacgccacaggcgctgccggcatgggacgcatgctggcttcctgtctgctactcagtacttgttttcagatg

SEQ ID NO: 79900 - DNA, 898 bp, Homo sapiens
cgagctggttggtatgccatttttggctttgtttttttttctctcttgaaatctcagagaaagagattgttacatccttggttttaaggtgttgggttcctttcctgcccctgaaatgtgggctctgccagtgccttttctgcttttctctgggttgtcactagagggcagcatacgcccgtgtttagaagtcagagctgcttgatttacggacagagaaccgagggcgcacactgcctccttgggctttaggagcacaaaattgtaatacccacgggatatctttattttactagcaataggatctcaataaggtaggaaaactgatatgcaggccgacttcttactagaaatggcaaacttcattgaattaaggattccagaatcaaattgctgttagccatgtgaacgttaccatctcacattgaaacaccggaggcgaggctcctgttctagctcctcttttatattacttaatgtgacttgactaaatttctgtgaagttgaggataagcaaatatttgtaccattttttatagaaataaatacaactgctgaagatgcccagcgaagaagaagaatatgaactgtcctgtgctgagcccaggccctttgcacatggcctccattctccacccccgcctaacaaggtgcctgtagtcagttttgttttaagacaaggacactaaagccggccgagggacccacccaaggccacacagggaggcggcctcaggatcatgggcagctccgtctggttccttcccaggctccgggccatatcatcagcaccctcccctcatcctgccccgctgctcatcgctcgcacgccacaggcgctgccggcatgggacgcatgctggcttcctgtctgctactcagtacttgttttcagatg

SEQ ID NO: 79901 - DNA, 774 bp, Homo sapiens
ttaaatataaatagtttcccaatcttcagtgaattctgtcttttagggattgactgtgggagtggtctctaagatatagtatttgaaatttaaagttagaagaatacttctgtaatctaccttgaataggtattttaaaatagcttaatttctgaagaaaagtttttaaatattttaatattgaaggttattttaatattttaaagtaactttagttaatctgtaatttttaaaatactttgatttggtgtgaaattaatgattttctcgtgtatagtttatctgtgtgccttataataaatggaccttgtgtccagtttattataattaagagtgtaaatccatttgttaattagtaaatcttacacatagcacacgatataggttggtacttatttaataagtactaaatttttatatagatgctttatactttaataatatttatatttacagaatttaattgatatttactgaatttaatattttaattattaattatcttagtcgagatgaaatcataagcatatgagttaaaaatattagctcctttgtgaggtggaataccatatttaaacattggtgtatgaaggcaggtaatttacttcatcattattttaacaagtgatgttgataaaagccagaggaacaaacatgggtgaaaaacatattaattaatcaaacttctagcaaataccaacccgggcatgtctttttatggttgtcttgaattaatactaattttacttccttacacaaaaatacaaacttcaa

SEQ ID NO: 79902 - DNA, 292 bp, Homo sapiens
gccacccttctctctgcaagactccagtaaacctttgcctcttcattagcatttgaatctctgagctcctataacaaggtctttgctggcctcacaccagtctgagtccctcagaacagaatttttcacagaccttcttgcttctgcctttcattattctcagatctttttggtgtttttgtttagtttggttttgtttgctcttgaataccaagagtccatctttggtagtatactaaatataatgaagctttagaagtattcagtggggaacattaatgaaaagttaaaa

SEQ ID NO: 79903 - DNA, 466 bp, Homo sapiens
tagatataggattttgcccctctacccaggatgagtccacttttctgctgctggggccatgatctgtgtcaaagggggccatgatcttcgacaaagagggcctttccgctgaaatgtaacagagtgctcctgaaaagtcatgaggagatcaagttctcattaaactatgtgagggggaaattatttaaagaaatttgcaaataatcctataattaataaatgaaactttaaatcattaatttatgtatttcacctcctaaatgatttcttttgcctgcttgcatttttgtacaccaagtcatgtttggttaaagtgactgttacgtcaggtgtgttggcatgtgcctgtactcccagctactcgggaggctgaggcgggaggactgcttgatattaggagtttgaggccagcctgagcaacatagtgatacctgtctcaaagaaaagaaagaaggaaagagaaaaa

SEQ ID NO: 79904 - DNA, 2848 bp, Homo sapiens
cctggcgaaagcaagacgtggaggttttaccaggggttagtagcttcctcttgctaactttttattgggacaaaaggcaagatggcaccattctgttctcagatatttgtctaaataaagcccttttaattttattttatttttgttgtgggattcttaagcagataagaagaaaagacaccttcctagtgagcagctgcccagctcctgctcagttttgcctcggggtagcacctccagccacagaaagcaagccggtaagtctctccaggtaggacttgctgcaacccagctgctggactgatctgaaacgggactttgcatactctccgaagtatggtgagttggtgctgacttcaaagttgcctggtgaaggaagataaggtggatcgcagagactaaggggagagggagaagccctgctcctcttctccccaccaaggcacaatgagcaacatctgtcagaggctctgggagtacctagaaccctatctcccctgtttgtccacggaggcagacaagtcaaccgtgattgaaaatccaggggccctttgctctccccagtcacagaggcatggccactactttgtggctttgtttgattaccaggctcggactgctgaggacttgagcttccgagcaggtgacaaacttcaagttctggacactttgcatgagggctggtggtttgccagacacttggagaaaagacgagatggctccagtcagcaactacaaggctatattccttctaactacgtggctgaggacagaagcctacaggcagagccgtggttctttggagcaatcggaagatcagatgcagagaaacaactattatattcagaaaacaagaccggttcctttctaatcagagaaagtgaaagccaaaaaggagaattctctctttcagttttagatggagcagttgtaaaacactacagaattaaaagactggatgaagggggattttttctcacgcgaagaagaatcttttcaacactgaacgaatttgtgagccactacaccaagacaagtgacggcctgtgtgtcaagctggggaaaccatgcttaaagatccaggtcccagctccatttgatttgtcgtataaaaccgtggaccaatgggagatagaccgcaactccatacagcttctgaagcgattgggatctggtcagtttggcgaagtatgggaaggtctgtggaacaataccactccagtagcagtgaaaacattaaaaccaggttcaatggatccaaatgacttcctgagggaggcacagataatgaagaacctaagacatccaaagcttatccagctttatgctgtttgcactttagaagatccaatttatattattacagagttgatgagacatggaagtctgcaagaatatctccaaaatgacactggatcaaaaatccatctgactcaacaggtagacatggcggcacaggttgcctctggaatggcctatctggagtctcggaactacattcacagagatctggctgccagaaatgtcctcgttggtgaacataatatctacaaagtagcagattttggacttgccagagtttttaaggtagataatgaagacatctatgaatctagacacgaaataaagctgccggtgaagtggactgcgcccgaagccattcgtagtaataaattcagcattaagtccgatgtatggtcatttggaatccttctttatgaaatcattacttatggcaaaatgccttacagtggtatgacaggtgcccaggtaatccagatgttggctcaaaactatagacttccgcaaccatccaactgtccacagcaattttacaacatcatgttggagtgctggaatgcagagcctaaggaacgacctacatttgagacactgcgttggaaacttgaagactattttgaaacagactcttcatattcagatgcaaataacttcataagatgaacactggagaagaatatcaaataataaagtagcaaaacaaattcaaataatccattccaaaatacaatgttatcaaccaactgcacaatcagtttatcctgacatattcaagtgataggataaagttggccatgtattatgaaaaagattatttgtgcattttattgactgggcaacactgcaggacagtcaaggtgatatataatttcctcactgcctggtaaaattaagcacactaaaccaagttatttttctttttaagagatacttacatttccatttattgtttgaaatgtcgatcaagagaatcaacagatgatagtccaatttttactcagtgactgttgtagcattttcctgtttactgattagagtggttattcattattcctcagattgctgaatcccatcaggctgttattatgaaggaatttgattgctttgctgcacagcaggacctgtgctttgagatttttttttctcttttaaaatatcctgtaactacaatgatggtaaagccatgttaaatgacttgattgtacttggagtaattgcacatttttttctatgcataaaaaaatgatgcagctgttgagaaaacgaagtctttttcattttgcagaaggaaatgatggaatttttctgtacttcagtatgtgtcaactgagagtcatatacattagttttaatctcttaatattgagaatcaggttgcaaaacggatgagttattatctatggaaatgtgagaaatgtctaatagcccataaagtctgagaaataggtatcaaaatagtttaggaaaatgagaggagaacagtaggattgctgtggcctagacttctgagtaattaataaagaaaaagaagtaccctttggcctac

SEQ ID NO: 79905 - DNA, 2794 bp, Homo sapiens
cctggcgaaagcaagacgtggaggttttaccaggggttagtagcttcctcttgctaactttttattgggacaaaaggcaagatggcaccattctgttctcagatatttgtctaaataaagcccttttaattttattttatttttgttgtgggattcttaagcagataagaagaaaagacaccttcctagtgagcagctgcccagctcctgctcagttttgcctcggggtagcacctccagccacagaaagcaagccggtaagtctctccaggtaggacttgctgcaacccagctgctggactgatctgaaacgggactttgcatactctccgaagtatggtgagttggtgctgacttcaaagttgcctggtgaaggaagataaggtggatcgcagagactaaggggagagggagaagccctgctcctcttctccccaccaaggcacaatgagcaacatctgtcagaggctctgggagtacctagaaccctatctcccctgtttgtccacggaggcagacaagtcaaccgtgattgaaaatccaggggccctttgctctccccagtcacagaggcatggccactactttgtggctttgtttgattaccaggctcggactgctgaggacttgagcttccgagcaggtgacaaacttcaagttctggacactttgcatgagggctggtggtttgccagacacttggagaaaagacgagatggctccagtcagcaactacaaggctatattccttctaactacgtggctgaggacagaagcctacaggcagagccgtggttctttggagcaatcggaagatcagatgcagagaaacaactattatattcagaaaacaagaccggttcctttctaatcagagaaagtgaaagccaaaaaggagaattctctctttcagttttagatggagcagttgtaaaacactacagaattaaaagactggatgaagggggattttttctcacgcgaagaagaatcttttcaacactgaacgaatttgtgagccactacaccaagacaagtgacggcctgtgtgtcaagctggggaaaccatgcttaaagatccaggtcccagctccatttgatttgtcgtataaaaccgtggaccaatgggagatagaccgcaactccatacagcttctgaagcgattgggatctggtcagtttggcgaagtatgggaaggtctgtggaacaataccactccagtagcagtgaaaacattaaaaccaggttcaatggatccaaatgacttcctgagggaggcacagataatgaagaacctaagacatccaaagcttatccagctttatgctgtttgcactttagaagatccaatttatattattacagagttgatgagacatggaagtctgcaagaatatctccaaaatgacactggatcaaaaatccatctgactcaacaggtagacatggcggcacaggttgcctctggaatggcctatctggagtctcggaactacattcacagagatctggctgccagaaatgtcctcgttggtgaacataatatctacaaagtagcagattttggacttgccagagtttttaaggtagataatgaagacatctatgaatctagacacgaaataaagctgccggtgaagtggactgcgcccgaagccattcgtagtaataaattcagcattaagtccgatgtatggtcatttggaatccttctttatgaaatcattacttatggcaaaatgccttacagtggtatgacaggtgcccaggtaatccagatgttggctcaaaactatagacttccgcaaccatccaactgtccacagcaattttacaacatcatgttggagtgctggaatgcagagcctaaggaacgacctacatttgagacactgcgttggaaacttgaagactattttgaaacagactcttcatattcagatgcaaataacttcataagatgaacactggagaagaatatcaaataataaagtagcaaaacaaattcaaataatccattccaaaatacaatgttatcaaccaactgcacaatcagtttatcctgacatattcaagtgataggataaagttggccatgtattatgaaaaagattatttgtgcattttattgactgggcaacactgcaggacagtcaaggtgatatataatttcctcactgcctgttccatttattgtttgaaatgtcgatcaagagaatcaacagatgatagtccaatttttactcagtgactgttgtagcattttcctgtttactgattagagtggttattcattattcctcagattgctgaatcccatcaggctgttattatgaaggaatttgattgctttgctgcacagcaggacctgtgctttgagatttttttttctcttttaaaatatcctgtaactacaatgatggtaaagccatgttaaatgacttgattgtacttggagtaattgcacatttttttctatgcataaaaaaatgatgcagctgttgagaaaacgaagtctttttcattttgcagaaggaaatgatggaatttttctgtacttcagtatgtgtcaactgagagtcatatacattagttttaatctcttaatattgagaatcaggttgcaaaacggatgagttattatctatggaaatgtgagaaatgtctaatagcccataaagtctgagaaataggtatcaaaatagtttaggaaaatgagaggagaacagtaggattgctgtggcctagacttctgagtaattaataaagaaaaagaagtaccctttggcctac

SEQ ID NO: 79906 - DNA, 326 bp, Homo sapiens
caggtcccagctccatttgatttgtcgtataaaaccgtggaccaatgggagatagaccgcaactccatacagcttctgaagcgattgggatctggtcagtttggcgaagtatgggaaggtctgtggaacaataccactccagtagcagtgaaaacattaaaaccaggtgcgagaacaataaaggttaaatggcatatgttgatttttatgagctcaatttaacactgtaaatatctaagaggtcatagggtggctaatactggcagcaagcaggtgttgtggtcattgtctctagcccaggtgaccccaacctatggataaggcat

SEQ ID NO: 79907 - DNA, 3106 bp, Homo sapiens
cctggcgaaagcaagacgtggaggttttaccaggggttagtagcttcctcttgctaactttttattgggacaaaaggcaagatggcaccattctgttctcagatatttgtctaaataaagcccttttaattttattttatttttgttgtgggattcttaagcagataagaagaaaagacaccttcctagtgagcagctgcccagctcctgctcagttttgcctcggggtagcacctccagccacagaaagcaagccggtaagtctctccaggtaggacttgctgcaaccccagctcctgctcagttttgcctcggggttagcaccttccagccacagaacgaagccggtagtctctcagtagacttggtgcaacccagctgctggactgatctgaaacgggactttgcatactctccgaagtatggtgagttggtgctgacttcaaagttgcctggtgaaggaagataaggtggatcgcagagactaaggggagagggagaagccctgctcctcttctccccaccaaggcacaatgagcaacatctgtcagaggctctgggagtacctagaaccctatctcccctgtttgtccacggaggcagacaagtcaaccgtgattgaaaatccaggggccctttgctctccccagtcacagaggcatggccactactttgtggctttgtttgattaccaggctcggactgctgaggacttgagcttccgagcaggtgacaaacttcaagttctggacactttgcatgagggctggtggtttgccagacacttggagaaaagacgagatggctccagtcagcaactacaaggctatattccttctaactacgtggctgaggacagaagcctacaggcagagccgtggttctttggagcaatcggaagatcagatgcagagaaacaactattatattcagaaaacaagaccggttcctttctaatcagagaaagtgaaagccaaaaaggagaattctctctttcagttttagatggagcagttgtaaaacactacagaattaaaagactggatgaagggggattttttctcacgcgaagaagaatcttttcaacactgaacgaatttgtgagccactacaccaagacaagtgacggcctgtgtgtcaagctggggaaaccatgcttaaagatccaggtcccagctccatttgatttgtcgtataaaaccgtggaccaatgggagatagaccgcaactccatacagcttctgaagcgattgggatctggtcagtttggcgaagtatgggaaggtctgtggaacaataccactccagtagcagtgaaaacattaaaaccaggttcaatggatccaaatgacttcctgagggaggcacagataatgaagaacctaagacatccaaagcttatccagctttatgctgtttgcactttagaagatccaatttatattattacagagttgatgagacatggaagtctgcaagaatatctccaaaatgacactggatcaaaaatccatctgactcaacaggtagacatggcggcacaggttgcctctggaatggcctatctggagtctcggaactacattcacagagatctggctgccagaaatgtcctcgttggtgaacataatatctacaaagtagcagattttggacttgccagagtttttaaggtagataatgaagacatctatgaatctagacacgaaataaagctgccggtgaagtggactgcgcccgaagccattcgtagtaataaattcagcattaagtccgatgtatggtcatttggaatccttctttatgaaatcattacttatggcaaaatgccttacagtggtatgacaggtgcccaggtaatccagatgttggctcaaaactatagacttccgcaaccatccaactgtccacagcaattttacaacatcatgttggagtgctggaatgcagagcctaaggaacgacctacatttgagacactgcgttggaaacttgaagactattttgaaacagactcttcatattcagatgcaaataacttcataagatgaacactggagaagaatatcaaataataaagtagcaaaacaaattcaaataatccattccaaaatacaatgttatcaaccaactgcacaatcagtttatcctgacatattcaagtgataggataaagttggccatgtattatgaaaaagattatttgtgcattttattgactgggcaacactgcaggacagtcaaggtgatatataatttcctcactgcctggtaaaattaagcacactaaaccaagttatttttctttttaagagatacttacatttccatttattgtttgaaatgtcgatcaagagaatcaacagatgatagtccaatttttactcagtgactgttgtagcattttcctgtttactgattagagtggttattcattattcctcagattgctgaatcccatcaggctgttattatgaaggaatttgattgctttgctgcacagcaggacctgtgctttgagatttttttttctcttttaaaatatcctgtaactacaatgatggtaaagccatgttaaatgacttgattgtacttggagtaattgcacatttttttctatgcataaaaaaatgatgcagctgttgagaaaacgaagtctttttcattttgcagaaggaaatgatggaatttttctgtacttcagtatgtgtcaactgagagtcatatacattagttttaatctcttaatattgagaatcaggttgcaaaacggatgagttattatctatggaaatgtgagaaatgtctaatagcccataaagtctgagaaataggtatcaaaatagtttaggaaaatgagaggagaacagtaggattgctgtggcctagacttctgagtaattaataaagaaaaagaagtaccctttggcctacagatcagagttttatttattttttattttttactttttattatagtttaagttctggggtgcatgtgcagaatgtgcagttttgttacataggtgtacaagtgccatggtggtttgctgcacccatcaacccgtcgtctacattaggcatttctcctagtgctgttcctccc

SEQ ID NO: 79908 - DNA, 814 bp, Homo sapiens
gtccactgtgtgagattaagtattgttttgtgaaacatttgtttctgttttgtacacgtgcataccggttcacgtggagtgggtgatggttgaagatgcatgtttttttgtgaggaaagcccctggctaggaaagcccctggctgacaggatagcgtcttgactcctcagtgtgacgcaggggtgtctgtggccagcttctgcctggctgtgctgcctcacctcccagccctcctgcctggaagcctgagctctagctgtaggagcggtttctcctcagtgcttggcggggacctgtccatggttccacagggctgtatgaacacatcgttaccagggcctggccatggttaggatggtccacgtgtctggccttcccttctcatcttttaactccttgaggtcagggttgaactttattcaacgctctgcccagcactggccccgtgcctgacacagagtggcagtaaccaggtattgctcgtctgtcgtgcgcaggtagtttatataagcctcatttaatcctcacagtagtccagtaagagagaggtaattaactattttccagatgaggcacagagccgtttagagcataatttgctaaaagccacccagctagtaagtggtagagctgagattcagactcaggttcatgtgacgccggagtcctcgccacccccactgcacatgcagcccagcaaatgtttgttgaatggatgtggtgatgctgcttcctttttggaagcagaatccccatctgcccaggattctagtttgtggccctttgtgtcaacatctcacgtatttacttgtgg

SEQ ID NO: 79909 - DNA, 273 bp, Homo sapiens
atcgctgagttgtgggtttaacttagctattaattgatggtgtacatggttacccatattctgtaacactttctcaaaagttgacttttcctccaaaccctgctccccatcagtaatctaagtgctttaaggtggttctgtttttcatctaattcctaaatatagtttgttttacagcctcaattaatcttgaagtttaggtataacccttactgacttactgaataactgtccttgaagtgaacactgtagtttaatttcaagaaccttcct

SEQ ID NO: 79910 - DNA, 1030 bp, Homo sapiens
  misc_feature (512)..(513): n is a, c, g, or t
gaaccggccagctcctgctctgtcccctcaggtgtcctgcaggcacagcatctcggggggcccaggccgatggcaggagttcctcatggccgaggagtctctgcctggcacgctgctgaagctggcggcacaggggctgggcatgcaggccgcctgcaccctgacgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacaagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacaggatggtcnnggctgtgctgctgcaccagggccgccttccccaccttttccagaggaaccttgttctaccggccagaagaacaagtaccgagcaccccgagggaagccggcccggcctcaggggacacccagaccctgcaaaagggggtcagtgtccgggagcctgggcgcagtggtgttgagggggccacattccagctgagtggccttgctctgtgtgagccccgtgccgagggcccctggcttggtagctgggaccctgggaaaccttctggtagctaaggagcggaactccctggggccccacgttccccccaggaaacggccagtgggggcgaacgtaaaacccaagtatcgtaacgaagaacgcacagcggcccagcagcaacagcaacacacatggcgggggcccgccctaagacatatacccgcgacgaggggggggcacgcaacagtatagccgggcacgcacaggctctcgtgtgtccaaccctggcggtccacacacacgacaccggccagcgcgc

SEQ ID NO: 79911 - DNA, 1327 bp, Homo sapiens
  misc_feature (809)..(810): n is a, c, g, or t
gaaccggccagctcctgctctgtcccctcaggtgtcctgcaggcacagcatctcggggggcccaggccgatggcaggagttcctcatggccgaggagtctctgcctggcacgctgctgaagctggcggcacaggggctgggcatgcaggccgcctgcaccctgacgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacaagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacagtctctcaggcatgtgcagggtcctaggaagcatacgaagtgcatcaggaaccccctcctgccccccgttgccgaggcagcactgccctctgctaggaacagctccgtgttggcctctctgtcccacacactgggccctgcagggcttctccgagactcttcaagttcaaggggcagcttcaggaaaccgaaaaacaggcttgtgtccttccattagcccctttatccacaagttcaggtatcacgcttgagccctggaggagctccaaggcttgcagccaggagccccgtagccagggatggtcnnggctgtgctgctgcaccagggccgccttccccaccttttccagaggaaccttgttctaccggccagaagaacaagtaccgagcaccccgagggaagccggcccggcctcaggggacacccagaccctgcaaaagggggtcagtgtccgggagcctgggcgcagtggtgttgagggggccacattccagctgagtggccttgctctgtgtgagccccgtgccgagggcccctggcttggtagctgggaccctgggaaaccttctggtagctaaggagcggaactccctggggccccacgttccccccaggaaacggccagtgggggcgaacgtaaaacccaagtatcgtaacgaagaacgcacagcggcccagcagcaacagcaacacacatggcgggggcccgccctaagacatatacccgcgacgaggggggggcacgcaacagtatagccgggcacgcacaggctctcgtgtgtccaaccctggcggtccacacacacgacaccggccagcgcgc

SEQ ID NO: 79912 - DNA, 792 bp, Homo sapiens
gaaccggccagctcctgctctgtcccctcaggtgtcctgcaggcacagcatctcggggggcccaggccgatggcaggagttcctcatggccgaggagtctctgcctggcacgctgctgaagctggcggcacaggggctgggcatgcaggccgcctgcaccctgacgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacaagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacagaggagcagcatggggaggtcatggagccccctcttggacctagatctggggattctggcccctggcttcagaggcccaggtggagcccacaccttctcctgcacctgctctcagacactcggctccacctcactgaggtaccagaagggcagctgggttcctatggaattctggaagcttttttcagcttctgctggctctacactgtggacggtctcaggggcaatgcctcagcctccccttggggggcaccgaccggagctgtgggtctctcaggccctgggcctg

SEQ ID NO: 79913 - DNA, 957 bp, Homo sapiens
ggcagccaggcgggcctccaaggccctgctcccagtgggcgcctatgaagtcttcgcccgggaggcggtgggcgcggtgcagctcggggcctgcttcctggagatgaggacgctggtcgagctcgggccctgggctggggactttgggcctgacctgctgctcaccctgctcttcctgctcttcctggcgcacggggtcaccttggacggggcctcggccaaccccaccgtgtccctgcaggagttcctcatggccgaggagtctctgcctggcacgctgctgaagctggcggcacaggggctgggcatgcaggccgcctgcaccctgacgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacaagcgggcccgctgtggctctgttggtcaccgtcacggcctacacggccgggcccttcacgtctgccttcttcaaccctgccctggccgcctctgtgacctttgcctgctcgggacacaccttactggagtacgtgcaggtgtactggctgggccctctgacagaggagcagcatggggaggtcatggagccccctcttggacctagatctggggattctggcccctggcttcagaggcccaggtggagcccacaccttctcctgcacctgctctcagacactcggctccacctcactgaggtaccagaagggcagctgggttcctatggaattctggaagcttttttcagcttctgctggctctacactgtggacggtctcaggggcaatgcctcagcctccccttggggggcaccgaccggagctgtgggtctctcaggccctgggcctg

SEQ ID NO: 79914 - DNA, 968 bp, Homo sapiens
caaaggagcttgacataattgtcctgttcctaatttggacactggtttacgaaagtgtggtgaccactggagactgttctctgacagtgtaacaggtattcgcccctttccccagggtactaagactcacgtggccctgacagccagcacagtctcttaggaggttccggagggtggcagtgggaatgagcgtagagccgtgtcatttcggagggctgagtgcgttccacacatcttcccaaagcccaccccaagaggctgtctaacgcagggggaaacaatgagaaaccagataccatggaattagcaaagaatttctcagatgaaacaggaaagggaggaaatccagaggggtttacattacacctggctcaggttgaaaggattcagggccagttgttggcaatattaaactccaggctgcgtttgaaagggtccttcactcgggcagccaaagagaggcgttcctgccaggataggttgcatcgctgcagatctccagccctacgtgcatacacacgtgcacacacacgtgtacacacacgtgcacacacatgtatgcacacacatgcatgcacacacatgtatgcacacacatgcatgcacacacgcacacacatgcacacatgcatgcatacatgcacacacgcgcgcacacgtgtgcacgcacatgcatgcacacagacacgcacacgcacacacatgcatgcacacacgcacacacatgcacacacacgcacacacgcatgcacacacacacatgcatgcacacacgtgcatcttggatatctcttgttaatgtcagccctctgccccaaactagatttgaaaacttgtaggtaatcaagttttctggttaagagaaataatcccagccaacagttagtaagctcttatgtgtcaggccttatccaaacagttcacacgaagaccagatccaaaaataaaagtgtgctttgtcaaaaaag

SEQ ID NO: 79915 - DNA, 892 bp, Homo sapiens
caaaggagcttgacataattgtcctgttcctaatttggacactggtttacgaaagtgtggtgaccactggagactgttctctgacagtgtaacaggtattcgcccctttccccagggtactaagactcacgtggccctgacagccagcacagtctcttaggaggttccggagggtggcagtgggaatgagcgtagagccgtgtcatttcggagggctgagtgcgttccacacatcttcccaaagcccaccccaagaggctgtctaacgcagggggaaacaatgagaaaccagataccatggaattagcaaagaatttctcagatgaaacaggaaagggaggaaatccagaggggtttacattacacctggctcaggttgaaaggattcagggccagttgttggcaatattaaactccaggctgcgtttgaaagggtccttcactcgggcagccaaagagaggcgttcctgccaggataggttgcatcgctgcagatctccagccctacgtgcatacacacgtgcacacacacgtgtacacacacgtgcacacacatgtatgcacacacatgcatgcacacacatgtatgcacacacatgcatgcacacacacgcacacgcacacacatgcatgcacacacgcacacacatgcacacacacgcacacacgcatgcacacacacacatgcatgcacacacgtgcatcttggatatctcttgttaatgtcagccctctgccccaaactagatttgaaaacttgtaggtaatcaagttttctggttaagagaaataatcccagccaacagttagtaagctcttatgtgtcaggccttatccaaacagttcacacgaagaccagatccaaaaataaaagtgtgctttgtcaaaaaag

SEQ ID NO: 79916 - DNA, 2137 bp, Homo sapiens
  misc_feature (158)..(158): n is a, c, g, or t
  misc_feature (585)..(585): n is a, c, g, or t
gttagcgcctgaacatgcggcagtctgcgggcgacccaggctccggacaggcagcggcggcggcgccggcggaggtggcggcggaggtggcggcggagacggccggcgcccggcgcggagcctagcgaggcagttcagcgcggcctcgggcctggtcnagaaggatgctgtcccgacagaaaaccaaaaacgaagtgtccaagccggccgaggtgcaggggaagtacgtgaagaaggagacgtcgcctctgcttcggaatcttatgccttcattcatccagcatggtccaaaaattccaggacgaactgatatctgtcttccagattcaagccctaatgccttttcaacttctggagatggagtagtttcaagaaaccagagtttccttagaactccaattcaaagaacacctcataaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaattttnttgatggtcagagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaatgcagcggaaatgtcattatgaacagatgttaaataggaaattattacttgttaacttcttacagcagtagtaccttctttaaaaaaaaaaaaagaatctgcggtattttttttaaaaaaaagtttactgctgtagtgtgaaatattgtctggaaagggatggtttaaatattaccatgatgtagttgaaatataaaataggatttggaaccttattgtgataaatatttatatatgatgtatgttcgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaaatacaaaaaaattagccgggtatgatggtgtgtgcctctagtcccagctacttgggaggctgaggtcagaggatggcttgagccctagaggcagaggttgcagggtcaagatcgcaccacttgcactgcagcccgagagagagagagccagaccttgtcgc

SEQ ID NO: 79917 - DNA, 919 bp, Homo sapiens
ctaaaaattagggttgatttttttgctctccattttgacttgcaagaaataatacctcaagataatctgatttattagctatttttaaacatttttaatcacaagctgtattagctttgctgctatataggtgttatgtgtaaatgccacctattaatacgggactgaaaacgttagagacacactgcattgcagataaaatgcaggcagcacaatatggcctaaactgccatagttttagaatgtgaaaaaaatgcatgtttacttacctgtatacaccatatgcatgcactagaattattaactaacgaggtgaggtattgcaaatgttcaaaaaagctctcttgaatctaggtagcatgaacaaattataaaatttgtttaaaaaagcaaacttgcatgcattattgtgacttcaagtttaaaaaatcgtcttacatgtgtacaatatgcaaattagttttagattagagagtgcagccattttgtgatctggtcagtagtggaattcgattttatgcagactggatgtaatatttgtaatccctgtgcaattttgtgacgtgcggttctaattcatgtgcagtgatatagtatagataaaagaatgagtaaaagaaaatacaagaattctaaagaaagttggttttagcccctttgatagtccatggttaagacatcctttataaaccaaagatggccagcacactgctaaccagtcaccaaatgtaagacccataagaaacccatatttaaaaatctgaattttttagaagaatgcaaaactttagtaaaccctaagtaaagtcaaaatggagaaggggaaatatacagatggctagttgcataaaattaaattttacctttataagacaatggtgaaatctggcttgaacttgcttatgtgtttaacctataa

SEQ ID NO: 79918 - DNA, 301 bp, Homo sapiens
atagtttctgtgggttaggaactgaggagcagctcagctgcctcaggatcccttctgaggctgcagccagagtattggtggggaccacagccatccagaactgctagctcaggactagaatattcactcccacgttcatccactctggctgctgtcagagaccgcagctcctcatcgcgtggcttctccacaggtgagtgtctttgtgaggcggttcttggcttcccccagagcaaatgaccagaaataaggagtggcccagaaggaaactgccgtgcatttttataacccagtctccagt

SEQ ID NO: 79919 - DNA, 411 bp, Homo sapiens
tttttagtagagacggggtttcaccatgttggccaggatggtctcgatctcttgaccttgtgatccgctggcctcagcctcccaaagtgctgggattataggcgtgagccacccgcgccgggctacaaagagccttctaatgtgagcagagctggcagttaccgaggaagcccaggtggaggtggagttctgaaacagccactgtggtgaaggagtgtgtgcagctgggactgtgggggaggagggttggagtgcaggacttgcttctcccctaacattttgttgtgaaaaatttcaaaaatactgaaacattgaagaaattgtatagtgaacacctttgtatctaccaccttgattctctataggtataggcactcaattttaataaaaaaaaaatagctgaaaaaaatt

SEQ ID NO: 79920 - DNA, 913 bp, Homo sapiens
caaaacattcaaaagtcaccaaaattgttaaaggataaatacgaacgtggtgcaagatagagaaaaacaaggatgtaataccattcaagagagtggggacatctggtgaaggcaggggactgggatgagggaggggcgccgggcctggggtgtgttgctgagattaccgcctggctggctcgtgggcacatttatttttcattgatttattcatttatttttcttcctcacatctcacaagcaagtgatctgcacagaaagtaagtgtcatattgtgtgtggactccggagccagaccactcagtttaagttctgtttctggtcggtttcacttctgcttactagctatggttcttggggaaggttattttaggtctctggtgcctcagttttctcatctgggtgtattgaaatatggaccttgcagggttctggtgagaattaaatgagttctgtgttgagaattaagtgagttaatgtatgcgaaagcttagaatcgtgccctgcggcatagtagatctatataagcatcagctattgccatcatcagcatcatcattttgtaaatgtaaggcagtttgaaatcaaaaaagtaaaaagacggtatggagctgtaaagaagtgagagggagggccaggcgcagtggctcacacctgtaatcccggcactttgggaggctgaggcaggcagatcaccagggtcaggagtttgagaccagcctggccagcatgatgaaatcccatctctactaaaaatacaaaaattagccaggcatggtggtgcacgcctgtagtcccagctacttgggaggctgaggcaggagaatcacttgaacctgggaggcggaggttgcagtcagccgagatggcgccactgcactccagcctgggtgacagagtgagattccatctc

SEQ ID NO: 79921 - DNA, 272 bp, Homo sapiens
aacataacagtattttgagaatagaatttaagagcatttgtaggaatacaaaaatatagaacattcaataagataaaattcacagcatctgtgatctaattgagaattactaagcattgtgaagctggaaaatggacccatatgaggtgaaaaatcaaccaattgaaactaacccagaactagcacaaatgtgagactcagcagataaatgcattaaaacagttattatacctttatttcagatcttcaaaagtgaagtggagacatgagag

SEQ ID NO: 79922 - DNA, 399 bp, Homo sapiens
taaaagaggaaagcctctttgcagttgagataagaggaaggcatctgtctcctgctcatccctgggaatagaatgtctcggtgtaaaacctgactgtatgttctgtttactgagataggagaaaaccaccttagggctgcaggtgagacatgctggcagcaatactgctctttattgcaccgaaatgtttgtgctcgtgcacatcaaggcacagcagctttccttaaacttatttatgacacagagacctttgttcacatgttctcctgctgaccctctccccactattaccctattgtcctgccacatccccctctccgagatggtagagataatgatcaataaatactgagggaactcagagaccagggccagctgcgcaggtcctccatatgcaga

SEQ ID NO: 79923 - DNA, 988 bp, Homo sapiens
  misc_feature (282)..(283): n is a, c, g, or t
ggcgggcgcgcggcttcggcgggggcggccggggccgggggcgcggcggcggcgacggcaaggatcgcggcggcggtggacagcggcggggcggcgtggccaagagcaagagccgccgcaggaagggcgccatggtggtgtcggtggagcccgcaccggcacgagggcgtcttcatctaccgcggggcggaggacgcgctggtcacgctgaacatggtgccgggccagtctgtgtacggcgagaggcgcgtcacggtgaccgagggcggcgtgaagcagganntaccgcacgtggaacccgttccgctctaagctggccgcggccatcctgggcggggtggaccagatccacatcaagcccaagtccaaggtgctgtacctgggcgccgcgtcgggcaccaccgtctcccatgtctccgacatcattggcccagacggcctggtctacgccgtcgagttctcccaccgcgccggccgcgatctggtcaacgtggccaagaagcgcaccaacatcattccggtcctggaggacgcgcggcacccgctcaagtaccgcatgctcatcgggatggtggacgtgatcttcgccgacgtggcccagccggaccagtcccgcatcgtggccctgaacgcccacaccttcctgcgcaatgggggccactttctcatctccatcaaggccaactgcatcgactccaccgcatccgccgaggctgtgtttgcttctgaggtgaggaagttgcagcaggagaacttgaagcctcaagagcagctgaccctggagccctatgagcgggaccacgctgtggtggtcggggtctaccgacctcttcccaagagcagcagcaaatagcacccagctcaggctcgcctgccatctccccaaggctgcgttgtgtttgctattattttctgtgtgttttctttgtgagtgttttgttttgttgtttttctattaaactgcataaagaaacggcacctatctgta

SEQ ID NO: 79924 - DNA, 1400 bp, Homo sapiens
cgcggctatgaaggggcggaggctgggcggcgttgctctgcgctctgcggctgacggcgcttttgtctccggtgagttttgtggcgggaagcttctgcgctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggttgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatattt

SEQ ID NO: 79925 - DNA, 1669 bp, Homo sapiens
cggtgtcatggccggctcctaccctgaaggtgcacctgcaatcctcgccgataagaggcagcagttcggaagccggttcctgagcgatccggcgcgcgtcttccaccacaatgcctgttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaagtatgtgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggggggatggtacttctgcgagattacggccgctatgacatggctcagcttcggtttaaaaaaggtcagtgtctatctggaaatttctatgtgagaggtgatggaaccagagtttacttcttcacacaagaggaactggacacgcttttcaccactgctggactggaaaaagttcagaacctggtggaccgccgactgcaggtgaaccgagggaagcaactgacaatgtaccgggtttggattcagtgcaaatactgcaagccccttctgtccagcaccagctaagaggcacctgctgccaacacgatgcaagcccgttgtgtttccgagctttttttaaaaaaaaatttgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttctcaagttctttctttgagacctcaatctgtcttagcattttgtaactaataactgaaattttattcaaaggaattgtaaaccttaaaccaccaatttatttccatgtgaaaaagtgttatatatgacaagtgttttttgattgtaattgcgttaaatcttttgagagtgtaaatgccgggctaggcaattgcagttaatacatacaggggttagtgaagggcttattaagttgtaggggaagcaagctgggaagaatcagatcagatattttcctgac

SEQ ID NO: 79926 - DNA, 1761 bp, Homo sapiens
cggtgtcatggccggctcctaccctgaaggtgcacctgcaatcctcgccgataagaggcagcagttcggaagccggttcctgagcgatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaagtatgtgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggggggatggtacttctgcgagattacggccgctatgacatggctcagcttcggtttaaaaaaggtcagtgtctatctggaaatttctatgtgagaggtgatggaaccagagtttacttcttcacacaagaggaactggacacgcttttcaccactgctggactggaaaaagttcagaacctggtggaccgccgactgcaggtgaaccgagggaagcaactgacaatgtaccgggtttggattcagtgcaaatactgcaagccccttctgtccagcaccagctaagaggcacctgctgccaacacgatgcaagcccgttgtgtttccgagctttttttaaaaaaaaatttgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttctcaagttctttctttgagacctcaatctgtcttagcattttgtaactaataactgaaattttattcaaaggaattgtaaaccttaaaccaccaatttatttccatgtgaaaaagtgttatatatgacaagtgttttttgattgtaattgcgttaaatcttttgagagtgtaaatgccgggctaggcaattgcagttaatacatacaggggttagtgaagggcttattaagttgtaggggaagcaagctgggaagaatcagatcagatattttcctgac

SEQ ID NO: 79927 - DNA, 835 bp, Homo sapiens
cgcggctatgaaggggcggaggctgggcggcgttgctctgcgctctgcggctgacggcgcttttgtctccggtgaggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaacacaatcaaaaaaaacccgggacactatcccgggcgggagacaagggca

SEQ ID NO: 79928 - DNA, 828 bp, Homo sapiens
cggtgtcatggccggctcctaccctgaaggtgcacctgcaatcctcgccgataagaggcagcagttcggaagccggttcctgagcgatccggcgcgcgtcttccaccacaatgcctggtaatcaccctgccccctcgcccggcctgtcgctggccgtctgtcccgccgcctcggagcattccgaaaagcccctgaccgccggccacgagtcaagctgccctacccgaggcactctccaaggggagagaaactcctaggccagcgactcaccctgctcgcagccaggacgtgaagcccctaagctgcccgtttgattttctcagggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaagtatgtgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggtaaccttttattgtcttggtagtgggatatgtgaagctattatatttgtgcacatg

SEQ ID NO: 79929 - DNA, 432 bp, Homo sapiens
ctctgcccggccgccctgtctaggaggcagcaaatatgaagtctatggaccctgcctcaggttattcaaataacatcctcaccattgatcaaatgctcaagaaaaagcagacttgtatagtggccgatgcaactactattaaacaacatgtgaagagagctactgatacctataatttgggaattgcccttgaacaccgaaaagaaatgctaaacctctggcagaagatccgaggggatttgattgggatagactctagaaatgaggccttttatgacaccttttctacttatacatggtcctggaatgtttgccaagaattactttctcctaaggacttaaggttatatgatgcctatgtgaatagaaattcctcccataactgcagatcctcttcctcatcagataccagtgaatgtgacacagactcag

SEQ ID NO: 79930 - DNA, 2137 bp, Homo sapiens
cgcggctatgaaggggcggaggctgggcggcgttgctctgcgctctgcggctgacggcgcttttgtctccggtgagttttgtggcgggaagcttctgcgctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggttgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatatttctactgtgtgtcatgttgacttctgctcttgaaattcgtggtagggagggtcttaatttctagacctgaggtttaattttaacatctcaatactttggagcaggaaagtgcttaaatcactttgtttaaaacatagtatcagtagacttctgaatttgggggcagaggcagttgggtctgccatgtatcaaccagttatgtgagcctaggccacgattattgcaggcctgtcatgactagatctgtaaagaagaagaaaaatgatcaccacttccagcccctctccttgagtctctggggcaaagaggactatcagtccaggaggctgtgggctttttcttttgtactcttcagcgtgttttacttacccaccaaaaaggctgcttaattcagattgttctcaaagtcagttggtaaagtgtccacaccacacagatgattatatctgctctcccagatctaagcaacttggcctttactcaaaagttggaggggtttttttttcttgtatccatcactcttgtacttcctgtcccacgtacaattgtattcactcctttgcccttcagaatatatttatttacactcccatctgggcgtgtgcatcattttattaacttgactgacttttgctaaagcgcaacaatgaagtacagtgtcttctgttaagccagttttgcttcctgagtgttcttaaaatgtcactaccctagaagcctgtgggttaagcatcactt

SEQ ID NO: 79931 - DNA, 1685 bp, Homo sapiens
cgcggctatgaaggggcggaggctgggcggcgttgctctgcgctctgcggctgacggcgcttttgtctccggtgagttttgtggcgggaagcttctgcgctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggttgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatatttaaaaaaacagaagaaaaaaacagagaaaacacaacacaaacagagaaaaacaaatacacaacgagcgggagcgcgcggacagaagaggcaaaacacacagaggggcgggggaacacaggaaacaccgccccggcccggagcaccgagaagcacaccgcgacacaacgaacaggaggaaccaacacacaaaaaacagccagcgagcaccgagacaggcgaaaaaaacaagacaacacaaggaacagaacaaaaacacacacagagacaacaggacggaacaacccg

SEQ ID NO: 79932 - DNA, 1330 bp, Homo sapiens
cgcggctatgaaggggcggaggctgggcggcgttgctctgcgctctgcggctgacggcgcttttgtctccggtgagttttgtggcgggaagcttctgcgctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatgaacatctgtctggggttcctttagtcttgaatgtcttatgctcaattatttggtgttgagcctctcttccacaagagctcctccatgtttggatagcagttgaagaggttgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatattt

SEQ ID NO: 79933 - DNA, 1419 bp, Homo sapiens
gctacgccgaacaaccattaacgcgactagcgatcacgtacggctctgtgcggggcgtttttacaacttcagtggcaacgcagtgctgtgagcagttttgtggcgggaagcttctgcgctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggttgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatattt

SEQ ID NO: 79934 - DNA, 1290 bp, Homo sapiens
cgcggctatgaaggggcggaggctgggcggcgttgctctgcgctctgcggctgacggcgcttttgtctccggtgaggtccagaggcctttcagaaggagaaggcagctctgtttctctgcagaggagtagggtcctttcagccatgaagcatgtgttgaacctctacctgttaggtgtggtactgaccctactctccatcttcgttagagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggttgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatattt

SEQ ID NO: 79935 - DNA, 1141 bp, Homo sapiens
tagttaaccgactttcctcgacgcgacgcagcggcgatccaactcccggtgtccccggaagtgatggagtccctagagggcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggttgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatattt

SEQ ID NO: 79936 - DNA, 2479 bp, Homo sapiens
gctacgccgaacaaccattaacgcgactagcgatcacgtacggctctgtgcggggcgtttttacaacttcagtggcaacgcagtgctgtgagcagttttgtggcgggaagcttctgcgctggtgcttagtaaccgactttcctccggactcctgcacgacctgctcctacagccggcgatccactcccggctgttcccccggaggtgagcggccctgtgggcttccccggctccccacccccatcgctagagtgctcgccgcgctagcagcctcgcgttccagggctgggggtgcgccgccgggatcctctctgatcgcccacgccccatctggggtccccattcagccgtcagccctgttttgtcctaaggtggtcctaactaggatccacgtggcccatcccacgcccacaggtgctgagttaggcatccctgccatgccctcccagagcaccttcacgatctccttgctgtcccaacacttagcgtgttgcgtgttaactaccctttgtctataaggtttgcaatgtggccctagtatcttccagggtacctaacacattgcagatattcatggtatgtttgttaaataaatgaacttgatagatttgaccctcatagagttatttggacttgcaaaaagtttgtagttaactccaatctgtgatgtgggagagacttctaggcaggttcctttctccagggcatgttcttatatttcccattacccaccacccccctgcaaaaggactgggcctatttcaggaaggtgactgatgcctgcactgtagcacaggggttgtgcattgtgccttgcaggaacaaaattttcaataaagtaaatgtttgtttgtttgtttttgagacggagttttgcttttgttgccgaggctggagtgcaatggcgcgatcttggctcactgcaacctctgcctcccgggttcaagcaattctgcctcagcctcccgagtagctgggattacaggcatgtgccactatgcccggctaatttttgtatttgtagtagagacagggtttcaccagcctcgccaacatggcgaaaccccatctctactaaaaatacaaaagttagctgggtgtggtggcagaggcctgtaatcccagctccttgggaggctgaggcgggagaattgcttgaacccggggacggaggttgcagtgagccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggttgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatatttctactgtgtgtcatgttgacttctgctcttgaaattcgtggtagggagggtcttaatttctagacctgaggtttaattttaacatctcaatactttggagcaggaaagtgcttaaatcactttgtttaaaacatagtatcagtagacttctgaatttgggggcagaggcagttgggtctgccatgtatcaaccagttatgtgagcctaggccacgattattgcaggcctgtcatgactagatctgtaaagaagaagaaaaatgatcaccacttccagcccctctccttgagtctctggggcaaagaggactatcagtccaggaggctgtgggctttttcttttgtactcttcagcgtgttttacttacccaccaaaaaggctgcttaattcagattgttctcaaagtcagttggtaaagtgtccacaccacacagatgattatatctgctctcccagatctaagcaacttggcctttactcaaaagttggaggggtttttttttcttgtatccatcactcttgtacttcctgtcccacgtacaattgtattcactcctttgcccttcagaatatatttatttacactcccatctgggcgtgtgcatcattttattaacttgactgacttttgctaaagcgcaacaatgaagtacagtgtcttctgttaagccagttttgcttcctgagtgttcttaaaatgtcactaccctagaagcctgtgggttaagcatcactt

SEQ ID NO: 79937 - DNA, 1737 bp, Homo sapiens
cgcggctatgaaggggcggaggctgggcggcgttgctctgcgctctgcggctgacggcgcttttgtctccggtgagttttgtggcgggaagcttctgcgctggtgcttagtaaccgactttcctccggactcctgcacgacctgctcctacagccggcgatccactcccggctgttcccccggagttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaagtatgtgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggggggatggtacttctgcgagattacggccgctatgacatggctcagcttcggtttaaaaaaggtcagtgtctatctggaaatttctatgtgagaggtgatggaaccagagtttacttcttcacacaagaggaactggacacgcttttcaccactgctggactggaaaaagttcagaacctggtggaccgccgactgcaggtgaaccgagggaagcaactgacaatgtaccgggtttggattcagtgcaaatactgcaagccccttctgtccagcaccagctaagaggcacctgctgccaacacgatgcaagcccgttgtgtttccgagctttttttaaaaaaaaatttgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttctcaagttctttctttgagacctcaatctgtcttagcattttgtaactaataactgaaattttattcaaaggaattgtaaaccttaaaccaccaatttatttccatgtgaaaaagtgttatatatgacaagtgttttttgattgtaattgcgttaaatcttttgagagtgtaaatgccgggctaggcaattgcagttaatacatacaggggttagtgaagggcttattaagttgtaggggaagcaagctgggaagaatcagatcagatattttcctgac

SEQ ID NO: 79938 - DNA, 1117 bp, Homo sapiens
cggtgtcatggccggctcctaccctgaaggtgcacctgcaatcctcgccgataagaggcagcagttcggaagccggttcctgagcgatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaagtatgtgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccaggtgagtacgatgggaaattacctattggtaatttccactgattaaagggaaaaggttctcctaaaaatcaaggtctctggctgtgttcttatacggtctgtgttcttacggtctaaaagtaaaagatttactgataacgagcataccttgttttattgcagttcactttatcacactgtacagatgtcatatctgttcatatattgaaagtctgtggcaaccctgcatcaagcaagcctaccagtgccgtttctccaccaccatatgctcacttagtgtctgtgtgtcatgctttggtgattctcagaatatttcagacttttttactattatgtatgttatagtgtgtgacgttactgttgtacttggtttggggttccacaaatcacatctgtgtaagacggtcaacttaataaatgcatgtgttgtgactgccccacc

SEQ ID NO: 79939 - DNA, 2180 bp, Homo sapiens
gctacgccgaacaaccattaacgcgactagcgatcacgtacggctctgtgcggggcgtttttacaacttcagtggcaacgcagtgctgtgagcagttttgtggcgggaagcttctgcgctggtgcttagtaaccgactttcctccggactcctgcacgacctgctcctacagccggcgatccactcccggctgttcccccggaggtgagcggccctgtgggcttccccggctccccacccccatcgctagagtgctcgccgcgctagcagcctcgcgttccagggctgggggtgcgccgccgggatcctctctgatcgcccacgccccatctggggtccccattcagccgtcagccctgttttgtcctaaggtggtcctaactaggatccacgtggcccatcccacgcccacaggtgctgagttaggcatccctgccatgccctcccagagcaccttcacgatctccttgctgtcccaacacttagcgtgttgcgtgttaactaccctttgtctataaggtttgcaatgtggccctagtatcttccagggtacctaacacattgcagatattcatggtatgtttgttaaataaatgaacttgatagatttgaccctcatagagttatttggacttgcaaaaagtttgtagttaactccaatctgtgatgtgggagagacttctaggcaggttcctttctccagggcatgttcttatatttcccattacccaccacccccctgcaaaaggactgggcctatttcaggaaggtgactgatgcctgcactgtagcacaggggttgtgcattgtgccttgcaggaacaaaattttcaataaagtaaatgtttgtttgtttgtttttgagacggagttttgcttttgttgccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggttgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatatttctactgtgtgtcatgttgacttctgctcttgaaattcgtggtagggagggtcttaatttctagacctgaggtttaattttaacatctcaatactttggagcaggaaagtgcttaaatcactttgtttaaaacatagtatcagtagacttctgaatttgggggcagaggcagttgggtctgccatgtatcaaccagttatgtgagcctaggccacgattattgcaggcctgtcatgactagatctgtaaagaagaagaaaaatgatcaccacttccagcccctctccttgagtctctggggcaaagaggactatcagtccaggaggctgtgggctttttcttttgtactcttcagcgtgttttacttacccaccaaaaaggctgcttaattcagattgttctcaaagtcagttggtaaagtgtccacaccacacagatgattatatctgctctcccagatctaagcaacttggcctttactcaaaagttggaggggtttttttttcttgtatccatcactcttgtacttcctgtcccacgtacaattgtattcactcctttgcccttcagaatatatttatttacactcccatctgggcgtgtgcatcattttattaacttgactgacttttgctaaagcgcaacaatgaagtacagtgtcttctgttaagccagttttgcttcctgagtgttcttaaaatgtcactaccctagaagcctgtgggttaagcatcactt

SEQ ID NO: 79940 - DNA, 1443 bp, Homo sapiens
gctacgccgaacaaccattaacgcgactagcgatcacgtacggctctgtgcggggcgtttttacaacttcagtggcaacgcagtgctgtgagcagttttgtggcgggaagcttctgcgctggtgcttagtaaccgactttcctccggactcctgcacgacctgctcctacagccggcgatccactcccggctgttcccccggaggtgagcggccctgtgggcttccccggctccccacccccatcgctagagtgctcgccgcgctagcagcctcgcgttccagggctgggggtgcgccgccgggatcctctctgatcgcccacgccccatctggggtccccattcagccgtcagccctgttttgtcctaaggtggtcctaactaggatccacgtggcccatcccacgcccacaggtgctgagttaggcatccctgccatgccctcccagagcaccttcacgatctccttgctgtcccaacacttagcgtgttgcgtgttaactaccctttgtctataaggtttgcaatgtggccctagtatcttccagggtacctaacacattgcagatattcatggtatgtttgttaaataaatgaacttgatagatttgaccctcatagagttatttggacttgcaaaaagtttgtagttaactccaatctgtgatgtgggagagacttctaggcaggttcctttctccagggcatgttcttatatttcccattacccaccacccccctgcaaaaggactgggcctatttcaggaaggtgactgatgcctgcactgtagcacaggggttgtgcattgtgccttgcaggaacaaaattttcaataaagtaaatgtttgtttgtttgtttttgagacggagttttgcttttgttgccgagatcgcactgctgtacccagcctgggccacagtgcaagactccatctcaaaaaaaaaagaaaagaaaaagcctgtttaatgcacaggtgtgagtggattgcttatggctatgagataggttgatctcgcccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgagcctctcttccacaagagctcctccatgtttggatagcagttgaagaggttgtgtgggtgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaataaagtggaatatatattt

SEQ ID NO: 79941 - DNA, 956 bp, Homo sapiens
cggtgtcatggccggctcctaccctgaaggtgcacctgcaatcctcgccgataagaggcagcagttcggaagccggttcctgagcgatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaagtatgtgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagttcactttatcacactgtacagatgtcatatctgttcatatattgaaagtctgtggcaaccctgcatcaagcaagcctaccagtgccgtttctccaccaccatatgctcacttagtgtctgtgtgtcatgctttggtgattctcagaatatttcagacttttttactattatgtatgttatagtgtgtgacgttactgttgtacttggtttggggttccacaaatcacatctgtgtaagacggtcaacttaataaatgcatgtgttgtgactgccccacc

SEQ ID NO: 79942 - DNA, 1016 bp, Homo sapiens
ataaaaagatattaattccactgcttcaagatcaaaaatctccatatggccaaaaaaaaatcacagttgctactcataacataaaaggctaacttcaaagaacttcaaattcataagaaaaaaataacctatataaaaatggacaaagggtatgaacagacagttctcagaaacattaaaaaatattcaacctcattcctcataaaagatccaagttaaaactctcctcagatatttatcttttcatattatattgaccaagatgaaaaaacatgggtatactcataagttacagataggtttgtaaattggttcaccctctacagaggaaatttggcaataattaccaaaagaacagacttcacaccttttgacctagcaattccagtcctagggcaccatctaggatatacagatatttttgcacatatgccaaatgccactcctgagggacccagaaaaaagtctaaacaaacaaacaaatggtttggcaataacctcataaattatatacaaatccttctataataaaatatacttatttattatgtctttttgttgtataattcaaattaaaatgtattaccttcttttttaaatatgcataaaggcagcaaatatgaagtctatggaccctgcctcaggttattcaaataacatcctcaccattgatcaaatgctcaagaaaaagcagacttgtatagtggccgatgcaactactattaaacaacatgtgaagagagctactgatacctataatttgggaattgcccttgaacaccgaaaagaaatgctaaacctctggcagaagatccgaggggatttgattgggatagactctagaaatgaggccttttatgacaccttttctacttatacatggtcctggaatgtttgccaagaattactttctcctaaggacttaaggttatatgatgcctatgtgaatagaaattcctcccataactgcagatcctcttcctcatcagataccagtgaatgtgacacagactcag

SEQ ID NO: 79943 - DNA, 983 bp, Homo sapiens
cggtgtcatggccggctcctaccctgaaggtgcacctgcaatcctcgccgataagaggcagcagttcggaagccggttcctgagcgatccggcgcgcgtcttccaccacaatgcctgggacaatgtggagtggtcggaagagcaagccgcggcggcggagagaaaagtccaggagaacagtatccagcgggtgtgccaggagaaacaagttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaagtatgtgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaaaaatttctaagaaaatggcaagtcctagtactaacactgaagaaaagagattgttctactcttgaagttacagtctgaggaacccacctcaaatgggagattgacttagcttcaagttatggccattaatcatcaatatcatcaatgaatgtaaaactgaatgtagatggcatctttgccacagcctctttatgccatttaaataagatcgctgtgttcagtatcttactagaacccacttgttcatgtaattcactggcttagaattggcatgttttctactgcctgtgaatcaggtttaaattgttgggcatagttttcaaagtcctctacaagagtgtgccctataaagtatgtcctcttatccc

SEQ ID NO: 79944 - DNA, 709 bp, Homo sapiens
gctacgccgaacaaccattaacgcgactagcgatcacgtacggctctgtgcggggcgtttttacaacttcagtggcaacgcagtgctgtgagcagttttgtggcgggaagcttctgcgctggtgcttagtaaccgactttcctccggactcctgcacgacctgctcctacagccggcgatccactcccggctgttcccccggagggtccagaggcctttcagaaggagaaggcagctctgtttctctgcagaggagtagggtcctttcagccatgaagcatgtgttgaacctctacctgttaggcagcaaatatgaagtctatggaccctgcctcaggttattcaaataacatcctcaccattgatcaaatgctcaagaaaaagcagacttgtatagtggccgatgcaactactattaaacaacatgtgaagagagctactgatacctataatttgggaattgcccttgaacaccgaaaagaaatgctaaacctctggcagaagatccgaggggatttgattgggatagactctagaaatgaggccttttatgacaccttttctacttatacatggtcctggaatgtttgccaagaattactttctcctaaggacttaaggttatatgatgcctatgtgaatagaaattcctcccataactgcagatcctcttcctcatcagataccagtgaatgtgacacagactcag

SEQ ID NO: 79945 - DNA, 547 bp, Homo sapiens
gctacgccgaacaaccattaacgcgactagcgatcacgtacggctctgtgcggggcgtttttacaacttcagtggcaacgcagtgctgtgagcagttttgtggcgggaagcttctgcgctggtgcttagtaaccgactttcctccggactcctgcacgacctgctcctacagccggcgatccactcccggctgttcccccggagttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaacccgtctccactcaaaatacaaaaaaaaattagccagtcgtggtggcaggcacctgtagtcccagctactcgggaggctgaggcaggagaatggcatgaacccaggaggcggagcttgcagtgagcggagatcgcaccactgcactccagcctgggcgacagagtgagactccgtctca

SEQ ID NO: 79946 - DNA, 280 bp, Homo sapiens
cagcctcccaaagtgctgggattacaggcgtgagccatggctcctggccctatagctgtttttaaaccccttgtggaaatgacattccagttctgtattcattactggaatccactgtttctcaaaggtttcatataatatatactttgccaatttagcccacagtattcattaacaggattaagtaaaacattagcctcattactaatatacatttaaatatttctacaatttgttctcagaaatttctaagaaaatggcaagtcctagtactaacact

SEQ ID NO: 79947 - DNA, 432 bp, Homo sapiens
ctactagatgcatcacaaaagaggcagcgtggatgtgggttcttaaggcagagtaggatgtttgaaaggtagagatgggggccttcctggtggaagggactgcatgagtacaggcgtaggagcaggtaatgatgaatttggaggcaaatgagtagtatttttgtctggagcacaggatttccatcagtgtcctgagaaaggagtaaagaggctacaaggccagcttcttcactcatatcatctcgtactgcttttgggacactgggcacaaacacaccgacctatttctaagatgatccatttgagcatctgcctccctcacattaatgtaggttgcaaaaaggcagggctcatctctttttttttttttttttttgagatagagttttgctctttttgcccaggctggagtgcaacggcgtgatctcggct

SEQ ID NO: 79948 - DNA, 803 bp, Homo sapiens
gtaacaatccctattttaaaattcccctaacaataatagaactgccagcatacttttctctttcagttgtagatgaatacattcgagagaatatgagctgtatttcatcctagattttaatattttcagatgtgactgtatttcctgatcattggtccaagttgtcctaaaagaaatttttctctccagacctaacagttttaactgcaagagtttactgtgggttatgttaatctgaattttaatagggccactaagaatctgagtgccttaggagattacccttatacccactgccatcacatccagtcaggcctgttgtgctctatataaatcttcccagctgaggggcaggtgcgggctaaaatccaactgcaattggctcccagacataattttatattttacagagaagcatcttattggcttatatgtgtttaaagaatggtctggcttatacatcttcagaaaatgagaattaaaaagtcaaaataattcttgacatctacagattgaacaaagaacttagaagaaataatactttatcttttcatcctggcattcctgagagaagagaaattgattgtttatcatgttggtttaatttttcaacccagacaatctgcagcaaggcacatggaccccaattttgatatcgtccatacagttttcattctatgcatggagctaattactgactttgcctgtaaagagaggattgtgtgcctaaattttgtctaacaaatgcaagcgtagaatgacatttactaatatttctatttcttccataggctaaataatag

SEQ ID NO: 79949 - DNA, 787 bp, Homo sapiens
gccaactcagtggagaaattttgggattttaggtcactctaagatttaaaaaaatagtttgattcgttaaacaaggctattgaagttaaattgatatttccttaaagatgattttagagaaaaattccttggcgagcttcgagaatgcgttcatggcttctgttgcctgtacctactgctatacttttttatgtggactaatttgtcttatttgaaaatttgattacaatatcaaatcctagatgaagcccttccattcttagggtgattctaaggagtactgataactaagctcttaaaaggcgaggaaatagtttattctactgcagattagggtaatcttaatacagacactctgatggtaattctaagcagtgttgataactaagcttttaaaagataaggaaatagtttattctacttcagagtagggtaattttaatgccctgaatatactctgaatcttttatagatagatttctggatgatttggcccaaaaaatctgataagctttggggaattttttaatttttttttctcttaaagagaaatcagaaatgtgggatttttttaaaaatttattttcagtagatattggagattatgctttgtacattaaatccagtttgatttttaagtgataattttcaattaaagactttttaataagacaactaaaaaattaaattttagtcaattacaataatattttttggagaagcattcccagatgtgcttttgacggggagttgatttcattagttgtttgggttgtttaatccagaa

SEQ ID NO: 79950 - DNA, 626 bp, Homo sapiens
gccaggagttcgagaccaggctgggcaacatagtgagatcctgtctctacaaaaaaaaaaaaaaaagaaaaaaatcagccaagcgtggtgacttggacctacaagtcacagctacttggcaggctgaggtgggaggatcacttgagcccgggagtttgaggctgcagtgagctatgatcatgccactacaccccagcctggatgacagagggagatcttgtctcaaaacaaaaccaaaagaattctggggaatggtagaaatgttctctgtgtggcctgtccagaagagtagccactaaccaaggccctgcccggctggcaggaaaaacaaaatataatttgggcagcctgggcaacatggacccccatctctacagagaataaaaaattggctgggtgtggtggtgtgtgcctgtggtttcagttatttgggaggctgaggcaggaagatctcttgatcctagaaggtggaggctgcagcgaactgtgatgattgtactccagtctgggttacagagtgagatccagagaacgaaagggagagagagagagtgagagagagagagagaggaagaaaggaagaaagaaagaaggaagaagaaagaaaaggaaggaaggaagggaga

SEQ ID NO: 79951 - DNA, 560 bp, Homo sapiens
tccagctaacattaagtcccggatcctgggcaagtgcacccataaagatatagcctgatcttaacaaacatttcgttctccttggacagacatccttagaattcccactcatagatgtgtcccagattcctccctatggaaattagcaagatgcttggttatctcttaaatcagaccttgtactgctatctaggggctatgctgagatctctgggcctggagggttcagagcagtgaagggggtggctgctgagaagaagctgcatacctgtgtgaggccattgctccaggttaagtcattgaaatgtttaatgcagagcagcttggttggggatttgagaggactgcctcttagaaaggtttaggaggatatgaggggttcagagttctcttttatatctgtccagatgtcctcattgtaccatgtctggagccaacttgactttataacctttaattaatttagataacacatttccgtactgtttaaggccttttgaggcaagatattgtatttgtactggtaaacctcagtgttgattaaatgagatatgggtctt

SEQ ID NO: 79952 - DNA, 398 bp, Homo sapiens
tagcttcatagttttgaggattttactgctgagtaacaagttttggaaagcagaaaaaataaatgaaaatataaataaataatatagagaaattaacttttagaaaacatagatcaattaatgtagatagtatagatcaattaacttttagaaaacatagcaagtaatacatgaaaagtatataaaacatacatggacagtttaatgaatgaataaaaagtgagcacccatgtagccaccatcaaaatattgttgttttttaatttttttgagacagggtctcactatgtcacccaggctacagtgcagtggcacagtcttggctcactgcaacctctgccccctgggttcaagtgattctcctgcctcagcctcctgcgtagctgggattacaggtg

SEQ ID NO: 79953 - DNA, 369 bp, Homo sapiens
  misc_feature (41)..(41): n is a, c, g, or t
attcgcggccgcgtcgacgtagtgatggggtcttgctatgnggcccaggctggtgttggactcctggccttaagcaatccccctaccctggcctgccaaagcactgggaatacacatatgagccacggtgcctggcctgaagtttttaatagaaatgtttaatgagttttcattcttgagtttgttgggaagcagcttttttggaagcctcccgaggaccacggccgagccctcaaggtatggacgcgtgagtgtgatggctatgttaggacaactccccttatttgcaaacttcctcactttctgttgcccgtcagcagccgggggagggggtgggggagcaagaactagagaggaaagagaccccct

SEQ ID NO: 79954 - DNA, 533 bp, Homo sapiens
ctgattctgcaaggatgaacactgcagcccaaggtcaatatctaatcaaggagatggcttagaggagcctgactaaagtttggtcgaggagaaatcttgtcagactctgtcattctcatatgtaagggatgagctgctcttcatctgagcaaaggaaaagaataaattctgggtgacaaaacaattagactgtctaggttttctgtttgccttccatcatattcattctcctcacttccctgccctgttctataccccaaagctgacctctttggacggcaccacctgggctctcctcagctggtttccatttgagtttggacagcgggaggcattcagggagatgggaggcaggaggaaaaagacatcagggtatattttctctgttctttctctgtttggggctgagtatctggtggtggttgtgtttctccacaattgcagctcttggcaagcagtcccttctccatggctccagctccatgggctctggaaacacttttctcctttgctatgtagcctagagagagcgc

SEQ ID NO: 79955 - DNA, 444 bp, Homo sapiens
ttttttctaattctgcaaagaaagttaatggtaacttgacgggaatagcattgaatctataaattactttggacagtatggccattttcatgatactgattcttcctatccatgagcatgaatttttttttcaatttgtttgtgtcctctcttatttccttgctttagcatcctagagaggaagtctcttctaattattttttattcagaactttctgacttatcctgggcaataaagaccattctcattaaatgtgcatttttataagcagttttgcacagatttaatggaagctaaacagaacatggtctccttcttcagtgataaccaaggacctgatacaatctcaaacaggaatcttgggcatccacacctttccatgttcaacagccacaaaaggaacatttgtaatgctgcaggttataaattcatggtgacaattt

SEQ ID NO: 79956 - DNA, 370 bp, Homo sapiens
gacaaaattttccgtagtcattatttatcaaggatgtggagagcaataaattaatgctttaaacctcaagtactatgtttgaagtgtatacttctctgttgaggtgtctcagaggcgttagggtcataagtgttcctctggataatgacaggaatagaacaaggtgaagaaggtatgccaaaaccacaactaagtgctatgagcatttcaccttgattctgagtaaaggagtctcgcttaacagctattaactgttaacaagccacctaaagtttagactttgtacaccaatgtctttctctgtaaaatatatctttgggctgggcacggtggctatgcctgtaatcccagcactttgggaggctaaggc

SEQ ID NO: 79957 - DNA, 275 bp, Homo sapiens
ggggacgaggggacgaggggcccatgcccagtcagggaagccgaaggcctggaggggcttccgggagcaggggctggagttcctctgccaggcaggaggctggcaccagacacccggcagagggaggcggcgagggcccagcaaggattctccccagcccctgtgcctgcgtctcctgcggcttctgtgcgcggaccgtgtcctgtgctgtgtagggaacgctgcctctcctccccatcccctggctgccttaaccctacttttctgattgtcat

SEQ ID NO: 79958 - DNA, 573 bp, Homo sapiens
ggggacgaggggacgaggggcccatgcccagtcagggaagccgaaggcctggaggggcttccgggagcaggggctggagttcctctgccaggcaggaggctggcaccagacacccggcagagggaggcggcgagggcccagcaaggattctccccagcccctgtgcctgcgtctcctgcggcttctgtgcgcggaccgtgtcctgtgctgtgtagggaacgctgcctctctgctcgggacgtggattcctttcccctcctcctcgcccggctacttctgacgcaggtcgtcaggactccgcttgggtgtcacccgtgcaggaagcctcccttagtcaagggccctcggcacccgccccatatgtgactagcagccctcctgtgtatttcatcgcgcccccgttgtttatatcagccattccactcaccacccttctgggcaaccctttatctcccgctctgaaatcccatcgctgagggctgggacccctcctcagtgcttatccctgtttccccgcgcgagtctggcgcctggcgtgtggaaggcgctcagtaaacgtttgtggagcgaaga

SEQ ID NO: 79959 - DNA, 449 bp, Homo sapiens
tgtctataatcccagcactttgccaggccgaggcgcatggaaagcttgagttcagttcaagaccagcctgggcaacacggtgagaccgtttctaaaaagaaagaaaaaaaaaatcagcccggtgtggtggcacacgcctgtggtcttagctacccaggagctgaggtgggagggtcacttgaagccaggaagtggaggctgcaatgagtggtgatcacgccactgccctccagcctggtgacacagagtaaagctctgtctcaaaacaaaacaaaacagaacaaaacatcgataaaacaacaaaaccaacaatcaatcaattaaaaaaccaccaactgaccgggcgtggtggtttgcgcctgtaatcccagcactttcggaggccgaggcaggcagatcacgaagtcaggagttcgagaccagcctgaacaacatggtgaaaccccacc

SEQ ID NO: 79960 - DNA, 716 bp, Homo sapiens
ttcaggtgacttagaatgcctgaccatgtgggaatgcagcccagtaggactcagtctcattttacccagcccctgttcaagatggagtcgctctggttcacacgcctcagacacagctactcaggaggctgagatgggaggatcacctgagcctgggaggttgaggctgcagtcagccgtggtggtgtcattgcactccagcctgggcaacacagtgagaccctatctgagaaaaaaagaagaagaagaagaagaagaaatacaacgtgatggcttcatctgagttgagggctctgtgcagctcctttgtggtggaatcctctgctctgctggcagggacgtttcatcataagtgtgtgttctgtatatccaggtgcaagtgatattttaaaatataaaactattgtttaaatttcatgtaagtagcatgatttttccttttgcaactctttcacccccaccccaatgtggttgctgtgtccgggacttcgccattggtggctcacagccgcaggtcagctgtaatcgtgcagaacccatctatgaatacacgacggtgtacctgtccattctcctcttggtgaatgtgtggaggttttctgattctttgcagtgaccaacagcaatctgtgcccagcaatgcaaatgccggactgagggatgcaccctgcacgctggccaagatgtcactgggcgccattggtgtgttttttttt

SEQ ID NO: 79961 - DNA, 219 bp, Homo sapiens
aaaaaatattggccatcccagtgcttgctaggacgtggagcaacctatacactcacccattgcctgtgggaatgcaaaatggtgcagtcaatttggcaagttcagcagcttctgaaaagcttaacctacacttaccatatgacccagcaatctcattcctaagtatttatggaagacaaacgaaaatttatggtcaacacaaaaacctgtatttgcatg

SEQ ID NO: 79962 - DNA, 386 bp, Homo sapiens
ctcaagctcccgacctcaggagatccacccgcctcggtctcccaaagtgctggaattacaggcatgagccacggtgcctggctgcctccagggttttaaaacaaattaatgctattagatggcttcacatattgcaggttttatgctacaggctctaaacttcctttgtgtaataagatatgtcagccttccctgatgttgatgatggcatgctccttttcctgtctccctcatttcactgtcctgttagaaatagcttagactggctggccacagtggctaacacctctaatgccagcactttgggaggccaaggtgggtagatcacttgaggtccagagtttgagaccagtcaggtaatctcagcactttgggaggctgagact

SEQ ID NO: 79963 - DNA, 643 bp, Homo sapiens
ggaaaatccagattcccctgccctttttctgcctgtccttagccctgtttcccagagtgaatcagggacaggtcagtacctctaaagaataagctcatgttgctccttgtctgttgacttagacttctggaccctcagcaatgtcccgggactcacactgggggaggcagggagaccagcatgccccctcttgccacttgtacttcccattttccccctggcaaggtgtggaacatttatactcccacgcccacacttaagactcctgtgctttatctgcaaggttaattccaacaattgataaatggatgaacagtgtttacattaagaggcttgtcaatggccttcactgcccgtcgaagcagtcggctttgatcacatgtcctttgtgttcagctctctctttgccctcagcctcctgagtagctgggacttgcaggcaagtgctaccgctcctagctaatttgttttattcttagtacagatggggtcttgctatgtggtccctgctggagtgctggttgctctctaactggctgcgagccccggggtaggcacactggtactggggctatagcaaaatccgtgctcggtaaagcacccttgctccttcaatgatgatttaccgagcacgtttgctcat

SEQ ID NO: 79964 - DNA, 85 bp, Homo sapiens
  misc_feature (51)..(51): n is a, c, g, or t
gtcaggatggccgagtggtctaaggcgccagactcaagttctggtctccgnatggagcgtgggttcgaatcccacttctgacaca

SEQ ID NO: 79965 - DNA, 443 bp, Homo sapiens
cccagcctagttacaggattttctatttaaatatcttttatctatgaaataggcttgtcaaataccagttacaggtttccatctcccactctctaagagctaatgcttctaggtatgaattttcacttatgtgaagtgtgtactgcacagttcaatctaagtgtaactatctgccaaagagtctgacttacctgtcttgaattccagctctgccctttactacctgtgtagtttaagacaagttccttgagctccctgagattcagtttcctcatcttataaagtggtaattatacctcacaaagttgttttgggacttaaaaagatgataaaagtaaagcactcagcaaaacgtaagtattcaataaacagaaatactgtggaacatcagatcatgctcatagatagtccctaaaccccatttaggttaaaataaatcatct

SEQ ID NO: 79966 - DNA, 287 bp, Homo sapiens
ggaaaatgtaatccaggctggacataatcacagcactttgggaggctgagatgggaggatcatttgaggccaggagttcgagaccagcctgggcatcatagcaacactaccccaacccgacattacacattttttttttttagattagctgggagtggtgggggtgcacacctgtagtcctagctactctggtggttgaggtgggaggatcacctgaatctaggagcttgaggctgcagtgagctatgattataccactcaatttcagcctgggtgacagagtgaga

SEQ ID NO: 79967 - DNA, 298 bp, Homo sapiens
acaaaatgacctatatattcaaatatttttgatctgcaatttgctggaaagcttatttaatttgaagtgccaaagttgtatacaattgaaatcaggttagttttaggaactttgctttaattcagttctactgaaaatttttatgggctgtatggtgcatggatcatctctaaatgtgggtccatggctcctgctttacagaccaccataaagaaagcgtcattttggggaaaataatacttatatttttaccgatttttctcaataatatttgttccctaaaagatgttcctaattc

SEQ ID NO: 79968 - DNA, 360 bp, Homo sapiens
cttacatgattaagtagcatcttcaaattttgaattcatagagttaatttagtgtaagtagtatccattgagggttttttactgtgttctccattgtcctacacagtgacaggatcaataagataggatgaatatcctcaaagcaaggccattggataattcaagttgtacacatgaagagaaaaaaataacatctgtgcaaaggagtatgttattttaagtgctaaagtgagagccccagacaaggctaactgcaataggaaattaacaaatctccaagatcctctccttctgttctcagtgttgtcttcttctagaggacacacacacttacaccccacgcccccagcccccaaagca

SEQ ID NO: 79969 - DNA, 427 bp, Homo sapiens
tttggccttgtttcactggctaatacctccaatacagtgttgattagaaatggtgagaatgggcatgcctgtctggttcctggtgttaggggtgaagcattgagtcttgtatcattgccaggatgtgacctgtaagtttgctacacttgccttttatctggtgacgaaaattgtcttttcttttattccgaagattttaattatgaaagagtgttttaattttgtgaaacgctttattgcatctattgagatggttgaattgttttctcctttattctgttaatatgatgaattacattgatggatttttgtatgttaaaccaaatttgcattttggggacaaactcacttgatcacgaacaattatcctttttatatattgctatgtttgacttgctaacatttcattaaagattttacatctata

SEQ ID NO: 79970 - DNA, 296 bp, Homo sapiens
gtttcacagtaggtcaaaagtacagtcctagagttaagagcagcattcctctgtggtcacatgtttttaacacagatgttgaactgtcgttgcacacatgtgccctgtgtggcttccccttctgtcaggaatgtagtcagcattcatgctgctgcctgcctttcatgacacccacagtcaaattgcagcttttagcaccctgaaaaaaaatacagtgagccttacaggaaagacattcccccaaagggcatcttgaattcttaatggtgtgaccccccccaagcccagctctcagg

SEQ ID NO: 79971 - DNA, 515 bp, Homo sapiens
tttgagacggagtgtcactctgtcgcccaggctggagtgcagtggcgcaatctcagctcactgcaagctctgcctcctgggttcacgccattcttctgcctcagcctcccgagtagttgggactacaggcgcccaccaccacgcctggctaattttttatatttttagtagagatggggttttactatgttagccaggatggtctcgatctcctgaccttgtgatccacccgccttggcctcccaaagtgaaacttttctttaaaatagagatgggatcttgctgtattgcccagactggtctcagactccttgccttaagcagtcctcccacctcagcctcctaaagtgctgggattacaagcgtgaagcattacatccaagtgaaacttcttgagatagttacataatgtttaaatctgctggtgtacaagttaataaagtgtagaactgaataaatattaaatattagatcaagtttctcatgtttaccttaacgtataaagatttatctta

SEQ ID NO: 79972 - DNA, 409 bp, Homo sapiens
actatgtgttctaaatcaaacaaaaatacccgctctactacttcttcctagaatttacaactgcaatcaattaactaagcaattatgttagtgtctgcctttccttctttaatctaggcatgataaggataacatccagctatctagccccatgcctggcatagaataagttatgtgctcaataactactttcactgaatgaatgaaagtcataaaacattaaaaaaaaaactattgcaaataattatctcagcttagaaattaagctttcataagatgcaatttaaaagtcaactttatttactgtatacactataatttgttttgtaaaacttttgaaatcaaaaccatttcatctttaaatactcaatctttaatatccatgtattttgcctcttctaataattca

SEQ ID NO: 79973 - DNA, 433 bp, Homo sapiens
cccagcagcccccagactacttctatccctgaaaacacctggcctcaatgttggcttgttatgttacctgcccaccctcatccttacctcctcctactcaagctgcctggagaagacctgctctcagctgcccaccgttcctcagtgtgagcaagatttgggtctctccagacctctgggaggtagggagttccctggcactggcagcattcagtggggaccccccagtggcatgatgaatggagaggatggctggaccccttccactacttatgtttataattttttttttttttaatgaacttgagccgggtgcagtggctcacacctgtaagcccagctgtcagggggcagaagcgggaggatagcttgagcccaggagtgcaagacctgcctgggcaatatactgagaccccattctccacaaaaagga

SEQ ID NO: 79974 - DNA, 1303 bp, Homo sapiens
aatgcatgcttctgcctgaaaggaacatcagtcctacaagatagagcagaggaagaaaggcagagtcatcatgtttagctgaactaacaacattctcaaaaaggcctttaaaataaggaggtaaaataactgaagcccaggaaaatgcagtagaatctcaaagaggatcttgttgagctttctttttttaaatgaatagagtgaggcacaaagagaaaataacacctagaacattttttcttctcctttatctcgtagccccagagttccaaaagttggtttgcatggacagattcagagcagtcccacagagcccaggtcctgttaataagaagaggcatgttacatgatacgcacaaagaaagtaagtgagaagtagttagaactacatcagtggaatcttttgcctctttttcttagccatcacaccatggaataattgttgttcctgactccttcctttaggcaattgttgtcaagacattttgggccagggctgtaatctaggaccaggagccatcagagtttatttaagaagaagtagagacatgcggcaacctaatagttgacggcagcaaatgaaacgagaagcacgtagagcccttaggtacaactggccttacctgacctagggtaacccttcttcccactcaacttcactaatgaactttgcaggcagtgtgatggctacttattattagatgctatgtccatttattattataaatacaggcatatgatgctagaaatgatagaagttagctgtatcagggtccctttatctaatattttgccatctagccctctgagggagaaccatctggtctttgtttgctggccaacttcaacataaccatccacccagtctttgcattagagtttcactttaggaattcattttccatgtctgttcacacatatagcttgaacaccagcatctcttttaagatttcattacctcttggctgtttcttactgttgccctctggctcttaccttcttctagttaatagtcatagtacctaaattttgtattgggaaaagacattccctctacactgcctcattaattctcatccttactcaagtctcttcaaccttgctcaaggctcatcatctagggcttggacagccctagtctgacccaaacttgggcattagtatttgcattgcttaaaagtaacccaccccggccctccctagtacacagttcccagcataaggaatatggtggcattatatcagtatctgaatgccagcaatgttcatgagtaagacaggtagaaatacattcaaacttgag

SEQ ID NO: 79975 - DNA, 394 bp, Homo sapiens
gagtacaccgatatcagtgggcgagcacacgccatggcggtaaatcttacccaaaaaaaaactattaaaaaaatctagtggaggtaggggagtaaacagaggtaccactcaaacaagaaatggcaaagtattaattgttgacattaagtgatgggtacatgggagttcattatactattctgtttacttcatatatgtttgaaattttccataattaaaggtttttaataaataatttcccttaattccccctcagtggaggagaaaattaataatcactgtccttcatataagttaaaatcttcaaaggaagtctctaaactttgttttctacaccaaacaatccctgtcctctacactttcttcatattcatcatagttacagctcaccttg

SEQ ID NO: 79976 - DNA, 316 bp, Homo sapiens
tatgagataacacatacacacataaccactaaaatatacctgtatgtctagattttcaggagatgatttcattatcctcttgaatggaaattggaagccatttgtgtcttttctctgatttatcaattgaaaacaagagactgaatagaaccacattttatttttgaaaaaagagtaacatttcctttataatacagattttgtgttaaaatgtgtagctttctagaccttagacctgtgccgtccagcagagctctttgtgatggtggaaatttctgtatctatacagaagccgcatatgactgttgagcatata

SEQ ID NO: 79977 - DNA, 979 bp, Homo sapiens
ggcgcctgtgacacaaaatggagaaagaggaaccgggagtggaaaggaagaaggaaaaccgagtaaaggaggttattcataagaacaggaaaggggccgaggggtagagaacacccgaaggaaagcgcaggaggccctcgtgagagggcaagggggaaaagatcgacgaagtaagagcgaaaagaggaaaggaaagaaagactttctagatgcggagtctccattttcagcagcgccatattcgcttttcctctcgccgcttttggctgggttttgtgtgcggcggtggacaggcgccagcacatttctgcagcttcagcagctctgctcagacacctggggagggccgcagggcccgggcgggggacgcgcgctcttggcccaggcccgggcgaggccccctccccggcctggcggttcctgcgcagcgccagccccgcgctcctctaggctgcaaagggggcctccgactcgggcccggcccggaggggacacctcactcggggccccgcggcagcccccaggggacgcgggccctctagtttcgcccacggtgtggctgggcatgcgtgccaaggggatgcgtaaccgagaaccgaaaaagacgaattaaccttcggggaggaggagagggcgcacgctgcgggtaccggggcttgggggcgctcctggaggtgacggggtcacctccacctgcgcggggccactctctgggagccggcgatcgatgcccgccgcggcgcctggccaggccccaggctctcgcggtcgcggaaaacgtccgggtcggggctcggcgggagcccaagcgggtccctggctcgggacgccagtccggaggcggcgaactccggtttcgcggtctcagcgatttaaggcgcgcagtgtttgaagctctcggggtacctccttggggcactgggggcggtccacgactcaaagtcggggtttcgccggatcccacgtgctttggaatcca

SEQ ID NO: 79978 - DNA, 400 bp, Homo sapiens
acgccaccacgcctgcctaaatttttttgtatttttagtagagatggggtttctccatgttggtcaggctggtcttgaacttctgagctcaggtgatccgcctgcctcggcctcccaaatgcccttgtaagatttttatcattgcattccccatcccaaatatagtacctgccgcttagtaggtattccataaatgcttgttgagtaaatgaatgcacataaattggatttcaatggatcacatttgaggggaaaaaaagaaagcatgccagttaataatcagtgtagtttatttaaaatctcttgatgtttattttaacaaaagccttcttggaattctaacactgaaataggatgtcattgaggcctttgtggttttagtagctgtgacctttaccat

SEQ ID NO: 79979 - DNA, 323 bp, Homo sapiens
tctgtgatgctgggatgggggaggaggtggcaggaaacatctataaggagagggcacttaaccaaaatgatgaccatatcttaacatgatactgcatataaagcactgggtacctttgtttttccatgtatatatgtgtgtttgtgtacacagatacacgtctttatatgtatacatatattctccatttgtttaaaaacttgattcccataccctaagagtgatgaaaatcattacataaatgacttattgcaaatagtgaaaagatgacaaagtatttctgtagttttataaaacaccacttgctattattattttcaagt

SEQ ID NO: 79980 - DNA, 607 bp, Homo sapiens
tttgagacagagcaactctgtctcaaaaagaaaaaaaaatatgctattcgtatacttagaaaattatgacatacatgcttcaccctgagtacctcattattattcagatactcattttaatattttacaatttctaaatgtttattttcacagaaggtataaattaaaagattaagaaaaatcctgccaagatcacgtcttaggcacacacagagagcagttgagcgtctgccacacctgatggtcttgagccgtgatggccttaactcctgagccccagtgccctgctccgtaattgatgctgtccactaaggcttgttaggcctaaaggagggaagtgtaagctaagtgtggtatctggtaggaaacccactctgggttgggtgtggtggatcacttgaggtaaggagtttgagaccagcctggccaacatgacaaaactccgtctctactaaagatacaaaaatcagccctgcatggtggcgcacacttgtaatcccagctattcaggaggctgagacaggagaatcgcttgaacccgggaggaggaggctgcagtgagccaagatcaggccattgcactctggcttaggcaacagagtgagac

SEQ ID NO: 79981 - DNA, 838 bp, Homo sapiens
  misc_feature (733)..(733): n is a, c, g, or t
  misc_feature (738)..(738): n is a, c, g, or t
  misc_feature (740)..(740): n is a, c, g, or t
  misc_feature (749)..(749): n is a, c, g, or t
  misc_feature (751)..(751): n is a, c, g, or t
  misc_feature (756)..(756): n is a, c, g, or t
  misc_feature (769)..(769): n is a, c, g, or t
caaaaaagtttcaatccagagttgggttccagctttctgtagctgtaagcattggtggccacaccacctccttacaaagcaactagaacctgcggcatacgttggagagatttttttaattttctggacatgaagtaaatttagagtgctttctaatttcaggtagaagacatgtccaccttctgattatttttggagcatgagaacattttggatttttttcatctctctctccccacccctaagattgtgcaaaaaaagcgtaccttgcctaattgaaataatttcattggattttgatcagaactgattatttggttttctgtgtgaagttttgaggtttcaaactttccttctggagaatgccttttgaaacaattttctctagctgcctgatgtcaactgcttagtaatcagtggatattgaaatattcaaaatgtacagagagtgggtagtggtgaatgttttcatgatgttgtacgtccagctggtgcagggctccagtaatgaacatggaccagtgaagcgatcatctcagtccacattggaacgatctgaacagcagatcagggctgcttctagtttggaggaactacttcgaattactcactctgaggactggaagctgtggagatgcaggctgaggctcaaagttttaccagtatggactctcgctcagatcccatcggtccactaggtttgcggcaactttctatgacattgaaacactanaagtntncgatgaagnantgggnaagaactcagtgnagccctagagaaacgtgcgtggaggtgggcagtgagctggtgaagagtacaaaacattctcaaggccca

SEQ ID NO: 79982 - DNA, 308 bp, Homo sapiens
gttacccagagcctactttaagccctcattttgtgtgtgtgagaaactcaatcattgtccccaaatgaagggacagtaaatgttcaccatctaaccagcagaaaagcttttgtgtttcaatgcagattacttagaaatgagaaatagaaagcggtttcaaagccagctaggtgtgatcatgcctgcagtttgcaacttggttcctgttcacagattgcagacgctaaaaggcatggaattcagctgccctcaccttttggctctgcaggttggaattctttttcctttcttgatgaatgtggctgcat

SEQ ID NO: 79983 - DNA, 558 bp, Homo sapiens
aactttattttcataaaaagaaaaaacataattaagagaaaataagcattctctccttcaaaagtaagttcatcttaaccaataaactgatgcaacaggtcctggatggttgagaaaccacctcattatgattctgagtattaattattaccatatactagataaacacaggagtcagaaaggattcagtatgatgacatagctgggcatacaccttaagtctaccagttagatatgtggacatgagcatattaattagacacactaaccgttgttacccttccctttaaattgagaaaaaataatagctacccaaataagtttgttatctaaatttaagagagattgtatgtaaattccctgacacaatgctcttgtataggaggcattaaaatggatctctatacagtagacattaacaaaaataataaaaataaaaataaatgaaagcttaaaacataggatattgtgggagtacagattgggtgtgcattacagtggcaaatttccttcacagataatttcttcccaaattcctacaaccatacaacatgtgtt

SEQ ID NO: 79984 - DNA, 450 bp, Homo sapiens
aatgtaaatgacgagttaatgggtgcagcacaccaacatggcacatgtacgcatatgtaacaaacctgcatgttgtgcacatgtaccctagaacttaaagtataataaaaatatatatatatataaaaataaaaaaataccttctaaataactcttggaggaaaagagatacaaacaaattacaggatttttgaagaataattacagataacaaaaatactacatgttaaaaatccatggaataatgttaaaaacaagtgtttaacaaatgaaataatgaaatcaatacaaatgaaataatgaaaataaataaattcccaactcaaaaacctagaaaaaagagaaagtaaacaacaacaaaaaaacacaagaaactactaaagataaaagtggaaattaataaagtagagaacagaaaaatagtggatcaaattaatcaaaatcttggtt

SEQ ID NO: 79985 - DNA, 272 bp, Homo sapiens
aggtagttctagccccagaaaatgggtcataaactgactttctgtgataatttactttttagagaaattgcaagcactactcagggttagtgttttgaaagaaactcaagtacacagaatagttttacaatgatatatctatttgtatcatcagaaaattaagaaaggacaaacagacttccaggttcctgtttatagaggggttttcgagtttccaaatcagtttctttcacacacacacacacacacacacacacacacacacacacaca

SEQ ID NO: 79986 - DNA, 273 bp, Homo sapiens
ctaatctagccatctgagttttaaacgaagccacgaaaccgatgtggtggaaccgcattgccatgtagactgtgcacagcacagaccggaagaaattaaaatcacctagggaatccatcttcaacatccatatccagtgaggtgctcttttagttattgcacagaattagtaccaaaaaaccctcaatatattaattttccaacagctgaattgtaccaatgtcctaaaaacatatttttaagcctatattgccaaacaggaagaacttccta

SEQ ID NO: 79987 - DNA, 453 bp, Homo sapiens
atttgtaataatgttatgagggtgagtacagtaggattgattttcaaaatatactaccaaattcatctgttctgagacacttccattggtctctaatctaaataggcaattaatcttccttttgcttttttggtcttaaaatttgagggctccttaacccattaacatcttcaggagaccaacctaggcaacacaattagccaggcatagtgacatgtgtctatggtcccagctatttgggaggctgaggtgggaggatcacttgagcccagaaggtcaaggatgcagtcagctgttatcacgccattgcactccagcctgggtgacagagcaagaccatgaatgaatgaatgagtgaatgaatgaatgaatgaatgaatgaaaaataagtaaataaagataaataaatatatctatatctatattctgatgttttgggggaacatttagaaa

SEQ ID NO: 79988 - DNA, 1051 bp, Homo sapiens
taagggggtcatggtcagtctgaactcaacaatagggctgaatgaatttaccaaaggaagctgccttatattatatgccaggctgctggggaaagcctcaggtcctggccagcccctgttctcacaagaacatgcaggttaccacataaataatggcatatgccttccataggacgtcaacctgacttaaatctacctataccctactctctattctttggtttttggttctcatccctgtggaaggaaatgggcctcttctggcatctcatgctactctgtgcttttccttgggctccaaattctagctcataaagatgcaagttttgcaatttcctataaatggttaagaaaagagcaagctgtccagagagtgagaagtttgaaaagagaggtgcataagagagaaatgatgtccatttgagccccaccacggaggttatgtggtcccaaaaggaatgatggccaagcaattaatttttcctcctagttcttagcttgcttctgcattgattggctttacacaactggcatttagtctgcattacacaaatagacactaatttatttggaacaagcagcaaaatgagaactttatttggtgcagtcagggctccatttagttccctcactctgcttctaatcaccccttctcccagccctcttctatttgatagaggtctgtccctcagatcagcaatgtcttagcccctctcctctcttccattccttcctgttggtactcatttcttctaacttttaataaacatttaggtataatacattacagtaagtgctatttagatacaaacttaaaacatactatatattttaaggatctaagaatcctttagagaaggcacatgactgaagtacctcagctgcgcagcctgtagccagtttttttaatgtaaaagtaagaatgccagccttaacctagccctgcagataaaagctaacttttattaataccagccctgaataatggcactaatccacactcttccttagagtgatgctggaaaaataaaatcaggggcttcagattaaa

SEQ ID NO: 79989 - DNA, 821 bp, Homo sapiens
aaaaaaaaaaaaaaaaaaaaattagctgggccggtgatgtgcgcctgtggtcccagctacttgggtggctgaggtgtgagaattgcttgaggctttttgtttgtttgtttgtttgtttgtttaagacaaaaatcttcctctcttgctcaggctggagtgcagtggcatgatctgggctcactgcagcatctacccatcaggctcaagggattctcccagctcagccttcctagcagctgggaccgcaggtgcacagtggcacaatctcagctcactgcaacttctgcctccatagctcttccacctcagccccagagtatgcccagctaatttttgttttttgtttttgtttttgtatagacagggtttcaccacattgccaaggctgctctcaaactctaggctcaggcagtctgcctgccttggcctcccaaagtgttgggattacaggcgtgagccaccatgcctggccagcttgctatacttctttatgttttttctacacatatgcaacttggaattagatctctgtcctctcagagactttccttatgctgtctggctcccaggagcctcttttcctagtcctttcactagtggcaggggttattctttctcttagagtcttagtgtcaccctcccccactgttttgccccagagaaatacatagtgaagattcttcccatattcttcctactaccctggaccctttcccgtttctcaggacagaaggacaggtttctcttaggctttcagatgtgctgcctcagtagtgcagcttcataacagactggcttctgagcagagtcagcagagaaga

SEQ ID NO: 79990 - DNA, 517 bp, Homo sapiens
gaataggcaaatccatagagatggaaaataagataagcagtccttgggggcaggggaagggggcaatggggcatgattactaacagatacagggtttctttttgggatgatgaaattgtcctgaattaggtaatagtgatgattgcaagaaagacctcatgaatatgctaaaaaccactgacttgtacactttaaaagggtgagctttaatactgtaataatactgtaaaattctcaatttttaaaaaagagaagggttgggcacagtagctcacgcctgtaatcccagcactttgggaggccaaggcaggcagatcacctgaggtcagtagttcgagaccagcccggccaacatggggaaaccccgtctctactaaaaatacaaaaattagctgggcatggtggcaggtgccggtaatcccagctactccggaggctgaggctgaagaaccgcttgaacctgggaggcgaaagttgcagtgagctgagattgtgccattgggctccagcctgggtg

SEQ ID NO: 79991 - DNA, 380 bp, Homo sapiens
tgttgcccaggctggtgcagtagtacaatgacggctcactgtaatagccttcatctcacctcctgggctcaggtgatccttccacctcagtctcctgagtagctatgaccacaggcacgcaccaccacacccagctaatttttctattttcggtagagacagggcctcattatgctgcccaggctgatcttgaactcctagcctcaagtgatcctcccacctcagcctcctgagcagttgggacaaggggctcataccaccatgccgggctaatttttaaatttttcgtagagacaaggtcttgttatatggcccaggtgggtctcaaactccggggctcaaatgcttctctcacctcagactcccacgtggctgggatt

SEQ ID NO: 79992 - DNA, 473 bp, Homo sapiens
catgattatttgaatttgtacttccctaagttctagtgaagttggacatattttcgatacattattgtcctttctgctttcctctgctgtaaattaattgcatgttcgtatcctctgctgtaaattaattgcatgttcatatcctctgctgtaaattaattgcatgttcgtatcctctggtgtaaattaattgcatgttcatatcctctgctgtaaattaattgcatgtgcgtatcctctgctgtaaattaattgcatgtgcgtatcttctgctgtaaattaattgcatgttcgtatcctctgctgtaaattaattgcatgttcgtatcctctgctgtaaattaattgcatgtgcgtatcctctgctgtaaattaattgcatgtgcgtatcctctgctgtaaattaattgcatgttcatatcctttgtccagtctccttttgggtggattatctttttcttagtgatttgtag

SEQ ID NO: 79993 - DNA, 255 bp, Homo sapiens
ttagcagaaaccagatggatgtttctgctaaagctcctccatacctgagcatgatttatccttgcatgtaacattttaaaccaccaaaagactttgcaattacaaatcatttccattttccctctctgactttatccttataattttctagagcaagtatcattatttcaactctgaaaaataaaaactaagcctcaggaagattaaatgactatgccaaatatactcagatagtaaatgttcatggcttttgga

SEQ ID NO: 79994 - DNA, 265 bp, Homo sapiens
ttttgtcagttctagaagctgtctggaggagtctttagggttttctaggtaaacaggtcatcagcaaacagtgacagtgtaacttcctctttaccaatttggatgctctttgtatctttctcttttcttttttttttcttttttttattattatacttcaagttctagggtacacgtgcacaacgtgcaggtttgttacatatgtatacatgtgccatgttggtgtgctgcacccattaactcatcatttacattaggtatatct

SEQ ID NO: 79995 - DNA, 433 bp, Homo sapiens
tagtagagacaaggtttcaccatgttggccaggctggtctcaaacccctgacctcaggtgatccacccacctcagcctcccaaagtgctgggattaaaggcatgagccaccacacctggcctatatctcttcttttagaatgtttggatcacataaattaatttttgcatttagtaagttttattttaacaaataacctaaattgccattagctatcctgctgagaaagctcaactgttcttactgtaacctgactttacaagcccactgggaagtgtcttatcacatgctgtgtgcaaacccttaatgtgccttaaagtagaactgggcacttcaagcatttattgatcaagtgctagcaaacatcacttccatcaccacaactatcaaaggtgcctagggtttccttgacgactaacaatatttaagattg

SEQ ID NO: 79996 - DNA, 520 bp, Homo sapiens
gctcgaccttggaaccaacccaaatgtccaacaatgatagactggattaagaaaatgtggcacatatacaccatggaatactatgtagccataaaaaatgatgagttcatgtcctttgtagggacatggatgaaattggaaatcatcattctaatttttgtatttttagtagagatgaggttttgccatgttggccagggtggtctcaaactcccagccttaggtgatccacctgcctcagtttcccaaagtgctgagatttggtgtgagccaccatgcctggctgtttaattcatttttaaatgagtttctcccaccatttatttatttcacatgaacagttggctgggatggggtggaagaaaaaaatggctggagttaaggagccaaggaattgaaaaacaggtgtgttggctgtgtcatttatgtgattttaaactcactgggaatgataaggggggttgtgaagtggtggaccagcagccaggcaccgaagtcatcagtgaattatggagagggg

SEQ ID NO: 79997 - DNA, 532 bp, Homo sapiens
aaaagagttagaggcacaagtttcccctgactcccatctcctagagggaaaccaacattaagagactggtgtatatctttatacattttactgtcttatttgtagaaacaaatgtttctgtatgaaatcattttttatatccttttctaccatttcttttataactcagctctctctcttgttctctctctctgtatgtgtgtgtgtatatatgtgtatatatacatatatatatatacatatactttaaacatctttttatggtgatagaggtgcatcgtttttagcaatttcgtagttgtcccctgtatgaagcagggggaaaggaagggctagtttcatgactgaagcagagctgctgtttgggcaagaacatcatctttatttagctttcataaaccatcttggttgtgaaaagacagcacagccaggatgggctgaaagtgcttggggatgtctaatctgcttagcataagcaaccaacaagattctggagaaagtcaggactcaagagtatgcaaatcaggagcca

SEQ ID NO: 79998 - DNA, 1235 bp, Homo sapiens
aaaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccagggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatctaaacatctagtagatgacttgcaggctgttggctaccagtttcctgtctgaggtgtatatgttaacttcgtgatcagtttgtatgtttgggactcttgtcctatgtaaagttaaggtgggccgggtgcagtggctcacgcctgtaatcctaacactgggaggccgaggcgggtggatcacctgatggtgaaacctcatctctactgaaaatacaaaaattagctgagtggtgacacacgcctgt

SEQ ID NO: 79999 - DNA, 1281 bp, Homo sapiens
aaaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccagggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatctaaacatctagtagatgacttgcaggctgttggctaccagtttcctgtctgaggtgtatatgttaacttcgtgatcagtttgtatgtttgggactcttgtcctatgtaaagttaaggtgggccgggtgcagtggctcacgcctgtaatcccaaaggtgttctttttatattctggatattaaccctttatcagatgcgttatttggaaatattttgtctcattctgtaagttaacttttctctctgttgattgtgtctttggatgccaaaaattcttaagttgatatagtc

SEQ ID NO: 80000 - DNA, 383 bp, Homo sapiens
atgcacccaggtggtctcagttcagagcttatgtgtgcatcctaacgctaacacatggaaaccaagatgtttcatggtatcttcccctgtcaaccaacttaggcacagtaggacctaagactcagatatttgtgatctggaaggaatccaagagatctcacctgattctgttatggtagaaggaataaaagattttgaggctgaaggctgggtctttctctctcttactgggtgacatataatgttaaactttctgaatgtcagtatcctcacctgaacaatggagaaaatcactcctgctttacagggttgtgaagattgaaatgtatgcatgtccaagggctttgaaaagtgcttgcagttcctctttcatttcctaccac

SEQ ID NO: 80001 - DNA, 338 bp, Homo sapiens
gtatttttagtagaggcggggttccaccatgttggccaggctggtctcgtactcctgacctcaggtgatcacctgcctcctcggcctcccaaaatgctgggattacaagcgtgagccaccgcgcctggcaccatcagtttttgatcctgatacttgtctgtcctcttggttctcctcatccctaatttaaccttgaacacaaaattcaacaggttttggcatatagaataaagattatcaggcaaaggcgcactcttgacctaatgatatatctacatttcatttcctgatctatcagcaatattaattgtctagaatgatgagaagtttagagaagt

SEQ ID NO: 80002 - DNA, 364 bp, Homo sapiens
gagacagggttttaccatgttggccaggctagtcttaaactcctgacctcgtgatccacccgcctcagcctccgaaagtgctgggattacaggcgtgagccgctgcacccgacccaacttgtcattttcaaagaaatatttcctccaaagccttgctgtccaatttgagagccactagtcacctcgtctaaatgtaagaaattaagtgaaagttgcagtagtgagtatcttagataacatgcagtctgaatgcaagataactaattagccagcccagaatctcaagattctttaaaccaactgtgcctaatttacagagtttataactcacatgttaaaccctgaaatacttatggtgatggct

SEQ ID NO: 80003 - DNA, 367 bp, Homo sapiens
agattctataaagaagagaatgatgtaagtgacccgggggcaatggggggagcttaaatttgaaactagaaaaaattttgaacaaaataatcataattgttagctgatgaaaaactagaaaatattttctgagtaaattcttgatttcagaaattaactataatttatattgctcttaatatcttacccttgaatataaatgattaatgccctttaaaatgtccttttttctagctaacctgatgtacatatgacattaatccaatagacttaggaataagatacagggggttttcctgaatgattcgagtatatccccattcatattaagaaaacaaagtattggccaagcgtggtggctcacgcc

SEQ ID NO: 80004 - DNA, 464 bp, Homo sapiens
gtgagccactgcgcctggccctttgcccatttctgaattgggttgttttgttgtttagttggagaagttctttatatatcctagatattaaacctttatcagatatatgatttacacatattttcttccattctgtgtgttgtcttttcttttttttcttttttcttctttgaaacggagtcttgctcgtcaccgaggctggagtgcagttggtgcgatctcagctcactgcagccttcacctcctgggttcaggtgattctcctgcctccgccacctgagtagctgggattataggtgtccgccaccacacctggctgatttttgtatttttagtggagacagggtttcaccatgttggtcttgaactactgacctcaggtgatgcacctgcctcggcctcccaaaatgctgagattgcaagcgtgagccactgcacccagccatttctgtgggttgtctttg

SEQ ID NO: 80005 - DNA, 363 bp, Homo sapiens
ggttcatttattcagccagtcactcaacccctctcctgtgccaggcctgactggaacactgagggtacagaggtgaaggtcccacagcctggtgtgcagatggtgacaattcatgtgagtggtttcattaaaaagcaagacagatcccacctctcccttgcctagaacactccattggctctcactccaccttcctcagatctgatcttcccaggctgctttctcagcatttaggtcttaatttagaagcagtcctctctaacctgaatgttaatgtagcctccctttgccccattgctggatctcttcccaccgactttaattttattcagcgtgcttatcatgggaagctactcctgtttg

SEQ ID NO: 80006 - DNA, 422 bp, Homo sapiens
acctgagttctaaatttatttctcaaagaagccaagctcctgagagagaaatgatactgtaagagtatctgcctggaaaccctgttgcctggagaccactcttgaagaacatccactgctgtggcctcttaaagatttaagacatctaatgaacagctgacagaaatcatcaatttgctcctcatttcagtgtcaaatcatgatgcaacagcagagtgaactcagtgtttttggtatgaagatctccatgtgtttccatcatcagcatctcctgtgctcttaatcttaccctggacacctgacccaggtgcccattctgtgaattctttcattgtaggaaagagaaacagatgttgacaccatgctcttggacttcccagcttccagaatcatgagccaaataaacctcttttctttataaa

SEQ ID NO: 80007 - DNA, 211 bp, Homo sapiens
gccagtgataaacagtcgaaaggattgtccctgccctcatggagactccagtctagcagaacagacagacgggtgttcatcatgtcatcacaacttctgtgtgacaagtgccatgaaggaaacgtacacatggagatgagagcacatcaccaagccctcctttcctcacagcatcactatcattcctggccaatcaatcccaccttgaaat

SEQ ID NO: 80008 - DNA, 317 bp, Homo sapiens
ccagatggtgaaggaagaggcttgtgtttgcctgagacccctctccaacagtggtgccagtgtttccagtggcgacagtagtggtagtggtgcgttgggagtagagaatgggaaggacttcaggggtgtcctgtgaccgataaaggacagcctgtcaaagccttgccccactgagtaataggcctacctctttttgatcacggtcaacaattagttggcagtgagtcttggagttcacatactcttcactcatttttctatatctgcttgaaacagtctttaccatgaaccaaatcagcattatcaatcatctgagg

SEQ ID NO: 80009 - DNA, 652 bp, Homo sapiens
ggccacaaatatcaggggaacggaaaagcttgctggacagacgaaaacaacaggtaccacacacctctaaaactacctctcaaaattgtgaaaagactagtgaaagtatacataactgtttgggaagcccaggcgggcggatcacctgaggtcaggagttcaagaccagcctgggcaacgtggtgaaacctggtctctacaaaaatacaaaaattagccgggcatgatggcgggtacctgtaatcccagctactcgggaggctgaggcgggagaatcgcttaaacccgggaagcagaggttgcagtaagcctagattgcgccactgcactctagcctgggcaacagagcaagactctgtctcaattaaaaaaaaaaaaaaaagtatacataactgcctaacagaggacgtaataggacacacccaataaatggtcattgttgtttcctccagcagcaccgtaagaaggaatacaaacaatctttcttctgcagtcttggagcaaacaggtgctgataaaatcaacattagttcaagcctcacccccaaagttgaactgagcctgaacctttctgaagaatgaagaatgtttagcaaacattcccctccagtgtgcctaaacttcatgtatctttgtacttcctcggccagat

SEQ ID NO: 80010 - DNA, 416 bp, Homo sapiens
gaagtaaaatactataaaaagcacccatgaaactaccacccaacccaagaagcacatcacatcaatgctttgagtctattcggtcctctctcttggcccagtctcatcttcctgcccatccctgaggtcgtcacagtctgagcttggtaattatcagcaccttgctttgtcttctctcagggattttgagtgtgtgtattcccaaacaatacgttgtttagtttggtttatttttctttacaaatatggtatcatgtatcatgccatatgtagtcttttaaaaaatgctaacattgatttaatatggatttaacataagatagcatcatagcatagtacttaaagcagtctattcatgaatccatgtaattctgcagatggcctaacttttattttgaaatgatttcaaacttcca

SEQ ID NO: 80011 - DNA, 536 bp, Homo sapiens
agttctgtaggatgctaatagaagtgtgatatttagatgctattaggacattgtatacatttctttaatgtggttattttaagtttaggactgtaaatgttccctactggaatagaaatatgtctctctccaactttccaccaaataaaatggttagagtgaatgcccagtttcacatctgccttttggagtttggaaagcttaaacaagtcagttaagagaatgagaagaatctcactgtgggtgataaggagtgtgtagtttgctgtaagggccactgatatgacaagaatgattatcccacagtaagaatgggtaaaacttaataaagttttctaactttattaaactcacattatttaatgaaaaaataactgcaaaggaccaatgagatcatgcatgctgctgtattcttgtgatggaatctaccaggattaagttgtatttaaatgaaaaaacaggtacacatttagagatcattgaccaagaaatgtaaatatatttgattaataaaacgtttttatgatgactcgaaa

SEQ ID NO: 80012 - DNA, 610 bp, Homo sapiens
ttttttttatattttctaaaatttttatttcttgttcattttgtttctaagatattcactcacatattaaaaataacaacgtctcaaaacatttgaagcaactctcttcatcccttttaaaaataccttgctgtttcgggggttaaaaaaagccacaagggagattaaaacaatacaaatatttattttcccaactcccctgccatgggttctgggacgtcaccgcctctttctggggcccgtttcatccttttcttttaatccaagaagcgatggtgttgtgcgcctgtagtcccagctacctgggaggcaggctgaggtgggaggatcttttgggtccaggattttgaggctgcagtaagccgtgttctcaccactgcactcgagactgggcggaagagcgagacactgtatcaaaaacaaaacaaaacaaaacgagaaggcatcgcggctctgtaacactccgtccagctctcgcactctcagatgcaaacttccacacaaactcctcggctcgccttgtcccgcgggactagcatatcaagccttccgggacacaccgtgcgatgatatatacgtatatacccctcttgcccttgaaggccggaag

SEQ ID NO: 80013 - DNA, 641 bp, Homo sapiens
gcttgctgatgggtccgggtggggcgcgcgtggactatgggcccgggaggtcccttactgtccccgagccgcgggttcctcttgtgcaaaacggggtggcactccaatcgcctgcttggtgattgtggcccccacacacctgtttctacagcgcttagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacaca

SEQ ID NO: 80014 - DNA, 573 bp, Homo sapiens
aaagcggcctcccaaaaggggattttggcccctgaagcccaaaaattggggcacgaggggccccccacacacctgttttctacagggtttcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacaca

SEQ ID NO: 80015 - DNA, 507 bp, Homo sapiens
ttttttttggaaccatgtgcgcctttattagctgagccactacttgagagggatgaagcagaaggagtgggtggcgccgatgccggaccggcattgctttacgggcttgtaggtgatggagaactcgcccaggtagtggccaatcatctcgggcttgacctccacctggttgaaggtcttgccgttgtggacgcccaccatgctgcccaccacctcgggcaggatgatcacgtccctcaggtgcgtcttcaccacttccggcttctccatgggcggcgcctccttcttggccttgcgcaggcgcttcagcaggtagtgccgcttccgccgcaggccccggttcagccgccgccgctggcgcgcactgtacagctgcatcagctgttcgtaggacatgtccagcagctggtccaggtccacgccgcggtaggtgaacttgcggaaggtccgcttcttcttctgctctacttctgccatcttgccggatcctcagaaagagctatttgc

SEQ ID NO: 80016 - DNA, 1052 bp, Homo sapiens
ttttttttatattttctaaaatttttatttcttgttcattttgtttctaagatattcactcacatattaaaaataacaacgtctcaaaacatttgaagcaactctcttcatcccttttaaaaataccttgctgtttcgggggttaaaaaaagccacaagggagattaaaacaatacaaatatttattttcccaactcccctgccatgggttctgggacgtcaccgcctctttctggggcccgtttcatccttttcttttaatccaagaagcgatggtgttgtgcgcctgtagtcccagctacctgggaggcaggctgaggtgggaggatcttttgggtccaggattttgaggctgcagtaagccgtgttctcaccactgcactcgagactgggcggaagagcgagacatttttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacaca

SEQ ID NO: 80017 - DNA, 1026 bp, Homo sapiens
gcttgctgatgggtccgggtggggcgcgcgtggactatgggcccgggaggtcccttactgtccccgagccgcgggttcctcttgtgcaaaacggggtggcactccaatcgcctgcttggtgattgtggcccccacacacctgtttctacagcgcttaggttcgaacagtaaccctgtaaactaggcactgctgtccccgctttactggtgggaaacgggctcggagagaataaatgagctgccctaagcgactgggacagaaccacagttctcagccgggctttctgagcccacgctgccgccccagcagggatcaaatcacacagtgtgagataagcctcaagagcgggtggccttatgctgccactgagaactgattgggttcagttgcctcatcaaaatccctaagcatggttttgttttgtttttgttttttttttttttagttttaaaggaagaggagattgacggttttcctctttccttatcttctcttcagattacaaagttcattggtaatctcaaatattattttgggcaagacttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacaca

SEQ ID NO: 80018 - DNA, 909 bp, Homo sapiens
ttttttttggaaccatgtgcgcctttattagctgagccactacttgagagggatgaagcagaaggagtgggtggcgccgatgccggaccggcattgctttacgggcttgtaggtgatggagaactcgcccaggtagtggccaatcatctcgggcttgacctccacctggttgaaggtcttgccgttgtggacgcccaccatgctgcccaccacctcgggcaggatgatcacgtccctcaggtgcgtcttcaccacttccggcttctccatgggcggcgcctccttcttggccttgcgcaggcgcttcagcaggtagtgccgcttccgccgcaggccccggttcagccgccgccgctggcgcgcactgtacagctgcatcagctgttcgtaggacatgtccagcagctggtccaggtccacgccgcgcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacaca

SEQ ID NO: 80019 - DNA, 2125 bp, Homo sapiens
ttttttttatattttctaaaatttttatttcttgttcattttgtttctaagatattcactcacatattaaaaataacaacgtctcaaaacatttgaagcaactctcttcatcccttttaaaaataccttgctgtttcgggggttaaaaaaagccacaagggagattaaaacaatacaaatatttattttcccaactcccctgccatgggttctgggacgtcaccgcctctttctggggcccgtttcatccttttcttttaatccaagaagcgatggtgttgtgcgcctgtagtcccagctacctgggaggcaggctgaggtgggaggatcttttgggtccaggattttgaggctgcagtaagccgtgttctcaccactgcactcgagactgggcggaagagcgagacaagataaaagcgaaacaggaagtcccgcccctctatggaaagtaaatggtagctcggaagggtcaaaagagtccgcggtttcgccgcgtgacttgctttttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacacatgcacttttgttttgtttttgttttgtttttaattagaggatgggtagtaggcagatgataaaatttataatatacatagaagtgaaataaatgggagttagcattttaatacaggcaagagctattacaacaacccaagtgagaaatgatgagggtttgtggaaggtttataaggaagaagggtgaacttaaaatatacaagtaaaataataaaagccatctataaaaaagcccatagctaatatcaacacttaatgttgggacaggaactggatgtctagctagtccagtgagacaaaaaagaaaaagcatacacactgggaaggaagaaagaaaactagctctactcacatataataaatactatcttatagaatgtaccaatggatgcacaaaaagagctcctagaactataagtcaatcatagaaaggttgcaggaaacaaggtcaatatacacaaggaaaattatattcctatatatcagcaataaacaactggaatttaaaacttaaaaataccatttgtgaatagcaccaaaaaaaattaaaggaatacttaggtataaatctaatatatggaggcctctatgctgagaactagaaaacacttggaagcagactacatcagattaaatggagaggtatacagttggccctctgtgggttctgcatccatggattcaaccccgaagagaaaatttttgggaaaaggaaaaacgagtaaaaataataaaaatttaaaaatccagtataacacctatttacattgtattaggtattgtaagtcattgagatgatttaaagtataggcatacctcaaagatactgcaggtttggttacagaccactgcattaaagtgaatatcacaatagagtgggttacacaaatgttttggttttccagtacacatagaagttatgtttatactgttgtctagtaagtgtgcaatagcattatgtctgctcagtatatatgc

SEQ ID NO: 80020 - DNA, 1275 bp, Homo sapiens
ttttttttatattttctaaaatttttatttcttgttcattttgtttctaagatattcactcacatattaaaaataacaacgtctcaaaacatttgaagcaactctcttcatcccttttaaaaataccttgctgtttcgggggttaaaaaaagccacaagggagattaaaacaatacaaatatttattttcccaactcccctgccatgggttctgggacgtcaccgcctctttctggggcccgtttcatccttttcttttaatccaagaagcgatggtgttgtgcgcctgtagtcccagctacctgggaggcaggctgaggtgggaggatcttttgggtccaggattttgaggctgcagtaagccgtgttctcaccactgcactcgagactgggcggaagagcgagacaagataaaagcgaaacaggaagtcccgcccctctatggaaagtaaatggtagctcggaagggtcaaaagagtccgcggtttcgccgcgtgacttgctttttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggacagtctcactctgttgcccaggctggagtgcagtggtgtgatctttgccatgttgcccaggctggtcttgaactcctggactcaagcgatctgcccatctcagcctcccaaagagctgggattatagataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacaca

SEQ ID NO: 80021 - DNA, 1015 bp, Homo sapiens
  misc_feature (651)..(651): n is a, c, g, or t
gcttgctgatgggtccgggtggggcgcgcgtggactatgggcccgggaggtcccttactgtccccgagccgcgggttcctcttgtgcaaaacggggtggcactccaatcgcctgcttggtgattgtggcccccacacacctgtttctacagcgcttagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacacaaaaaaaaaanaaaaaaaacaaaaaaaaaaaaaaaaaacaaaaagaacggaacaaagacacaaaaaaaaacacaacagaagaaagaggaagggggggggggcgggggggccccgggggggccggggaccccccagccccacccggggcgcccgcattagagaggtccatcacatcatccatcgctaagaaccaccagcaacacatgaacaacatggattaaatacacatcacaccatgttatgtgctctctaagaacaaccaaacgtatccgtagctaacagttagcaaactacgacatctatatgttcaatattgattaatatttgtttaaagtcagttgacaatctctgtgatatcttgtacaattttaacaa

SEQ ID NO: 80022 - DNA, 1147 bp, Homo sapiens
ttttttttatattttctaaaatttttatttcttgttcattttgtttctaagatattcactcacatattaaaaataacaacgtctcaaaacatttgaagcaactctcttcatcccttttaaaaataccttgctgtttcgggggttaaaaaaagccacaagggagattaaaacaatacaaatatttattttcccaactcccctgccatgggttctgggacgtcaccgcctctttctggggcccgtttcatccttttcttttaatccaagaagcgatggtgttgtgcgcctgtagtcccagctacctgggaggcaggctgaggtgggaggatcttttgggtccaggattttgaggctgcagtaagccgtgttctcaccactgcactcgagactgggcggaagagcgagacaagataaaagcgaaacaggaagtcccgcccctctatggaaagtaaatggtagctcggaagggtcaaaagagtccgcggtttcgccgcgtgacttgctttttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacaca

SEQ ID NO: 80023 - DNA, 1521 bp, Homo sapiens
  misc_feature (1157)..(1157): n is a, c, g, or t
ttttttttatattttctaaaatttttatttcttgttcattttgtttctaagatattcactcacatattaaaaataacaacgtctcaaaacatttgaagcaactctcttcatcccttttaaaaataccttgctgtttcgggggttaaaaaaagccacaagggagattaaaacaatacaaatatttattttcccaactcccctgccatgggttctgggacgtcaccgcctctttctggggcccgtttcatccttttcttttaatccaagaagcgatggtgttgtgcgcctgtagtcccagctacctgggaggcaggctgaggtgggaggatcttttgggtccaggattttgaggctgcagtaagccgtgttctcaccactgcactcgagactgggcggaagagcgagacaagataaaagcgaaacaggaagtcccgcccctctatggaaagtaaatggtagctcggaagggtcaaaagagtccgcggtttcgccgcgtgacttgctttttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacacaaaaaaaaaanaaaaaaaacaaaaaaaaaaaaaaaaaacaaaaagaacggaacaaagacacaaaaaaaaacacaacagaagaaagaggaagggggggggggcgggggggccccgggggggccggggaccccccagccccacccggggcgcccgcattagagaggtccatcacatcatccatcgctaagaaccaccagcaacacatgaacaacatggattaaatacacatcacaccatgttatgtgctctctaagaacaaccaaacgtatccgtagctaacagttagcaaactacgacatctatatgttcaatattgattaatatttgtttaaagtcagttgacaatctctgtgatatcttgtacaattttaacaa

SEQ ID NO: 80024 - DNA, 615 bp, Homo sapiens
cttaaataacgtgtgtagaagacttagtgcattgtctggcatatagagagctttcaataatcaacagctattattatggtgaggcaagagcacaagctcttgagtcatacctctaacattcacttggctttactactttaatttgtgtggcaccgaccaaagcacttaatttccccgtgcctcagtttcttcacctttgaaataaggataataatagtgaagaagttaatatatgtaaggaatttaaaatagcatttgacacataagtgccatgcaagtgttagttgttaatgactgttgctgtcgactctggttagactgtaaattccttaagttatcatctttttttattgattttcccttcccccacctacaaaacctatcttagtggtgaaacataagcctgaccaaatgttttattttggggcatacttaactaataagtctgaagtgacaaggatttactgtgttgtgctgtactcagccataaggaacattctaaagcagaagttggcagactttttgtgaagagccagatagcaaatactttagacttcacagaccatgtggtctctggcacaatttctcagctctgcagttctagtggaaaagcag

SEQ ID NO: 80025 - DNA, 501 bp, Homo sapiens
cttaaataacgtgtgtagaagacttagtgcattgtctggcatatagagagctttcaataatcaacagctattattatggtgaggcaagagcacaagctcttgagtcatacctctaacattcacttggctttactactttaatttgtgtggcaccgaccaaagcacttaatttccccgtgcctcagtttcttcacctttgaaataaggataataatagtgaagaagttaatatatgtaaggaatttaaaatagcatttgacacataagtgccatgcaagtgttagttgttaatgactgttgctgtcgactctggttagactgtaaattccttaagttatcatctttttttattgattttcccttcccccacctacaaaacctacggccatgtacaacaacggccttaaccctgccacaaccacgccttcggcgcccaccttgccttttacacccaccacaccttcggctggtcgcccctaccattcaaacacccccggttgc

SEQ ID NO: 80026 - DNA, 2668 bp, Homo sapiens
cgggaaagctgcagacgaggcagggagaggcgggacttcgcgggcgagacgtcatcggggcgccggaggcccggggcgcctgggagtttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagcacagcttttcttgtgtcctgtattctctgtctaatgtgttgcccaaataatacctaattgttagccattcccctccatctctggcctaaaagtgatagtccaggtatccacatgggctggttcccagaactgccattgctcactctccaaagaggggaaggtggggaaggggaaggtgactatagctcagctcctgagctagtatctggctgttatttcaacaaccggagttggggtttgggctcattttttcccctagccagcaattatggaccagtagtaacacaagtgacagcttcctgtgactgacttcacaattaggaggtctaagattccatttgggtatttgcttaaggatcccacataattgtcccaacggtcattagtagaggggaggtaagccttcattaataataaagagaaagcccacattcaaggt

SEQ ID NO: 80027 - DNA, 753 bp, Homo sapiens
aaataaaaaatataaaataaaataaaatagttacaataaaacattgtttatgtgttcattttcttacaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggtaaaataaaagtaacataaagcatgaagttaattaatctgtaacatcatactcttagaatttttccgcttctgtgcactaatgttttaccagtcatcttgagttctttaagttgttactgcttgtagaatttataattgttactataagtcaccttcctttttttagacttggggtgaaatgctttgtattgattaggaaatgaaaagtgctttttttggtactgtatctatgaaactccaacattttttttttttaccagcccttccctcatcagcaaaatgttgtaacagcacatactttcccagtatgtttgtatttaaacttcatgaaaagtaatccatggataaaattactctcataaagcagtgtaaacacctcagagagatatttttgtgggttcatggcaatagattatcaggtgacttgctttaaaacccgaaaatttgtccaggcaccatggctcacgcctgtaatcccagcacttttggaggccgaggtaggcggatcacttgaggtcaggagttcaa

SEQ ID NO: 80028 - DNA, 1790 bp, Homo sapiens
cgggaaagctgcagacgaggcagggagaggcgggacttcgcgggcgagacgtcatcggggcgccggaggcccggggcgcctgggagtttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagctaaaaaaaaaaagaaaaacaac

SEQ ID NO: 80029 - DNA, 2607 bp, Homo sapiens
  misc_feature (2)..(2): n is a, c, g, or t
  misc_feature (12)..(12): n is a, c, g, or t
  misc_feature (15)..(15): n is a, c, g, or t
gnaacctttganaanccgacagatgggggaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagcacagcttttcttgtgtcctgtattctctgtctaatgtgttgcccaaataatacctaattgttagccattcccctccatctctggcctaaaagtgatagtccaggtatccacatgggctggttcccagaactgccattgctcactctccaaagaggggaaggtggggaaggggaaggtgactatagctcagctcctgagctagtatctggctgttatttcaacaaccggagttggggtttgggctcattttttcccctagccagcaattatggaccagtagtaacacaagtgacagcttcctgtgactgacttcacaattaggaggtctaagattccatttgggtatttgcttaaggatcccacataattgtcccaacggtcattagtagaggggaggtaagccttcattaataataaagagaaagcccacattcaaggt

SEQ ID NO: 80030 - DNA, 2602 bp, Homo sapiens
cgggaaagctgcagacgaggcagggagaggcgggacttcgcgggcgagacgtcatcggggcgccggaggcccggggcgcctgggagtttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagcacagcttttcttgtgtcctgtattctctgtctaatgtgttgcccaaataatacctaattgttagccattcccctccatctctggcctaaaagtgatagtccaggtatccacatgggctggttcccagaactgccattgctcactctccaaagaggggaaggtggggaaggggaaggtgactatagctcagctcctgagctagtatctggctgttatttcaacaaccggagttggggtttgggctcattttttcccctagccagcaattatggaccagtagtaacacaagtgacagcttcctgtgactgacttcacaattaggaggtctaagattccatttgggtatttgcttaaggatcccacataattgtcccaacggtcattagtagaggggaggtaagccttcattaataataaagagaaagcccacattcaaggt

SEQ ID NO: 80031 - DNA, 1934 bp, Homo sapiens
cgggaaagctgcagacgaggcagggagaggcgggacttcgcgggcgagacgtcatcggggcgccggaggcccggggcgcctgggagtttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggtaaatctggtcactggtcgtggctcttccaaaaatgcttctttacccatggcaggcaaaataaaactttgcatattattatacacttgcttaagaaaagccttcttagtctagaacaataatgaatgagccctttggtaactatgtatctttggacaagtcagtttacttcttttagtctaattgtctgtaaaatggggatgataacagtattgacctcataaggtaatcaagatgctttaatgagataacatgtagaatatttaacacaatgtcttggcacagagtaaacactctgtacttataagcccttattcgtaagccctaataattgtttgactagatattatagttagggtctaggttagaatactaagttctggttgggaattagcccttaagagggctgggaaggaattataagcaaataggccggttggagtggggccccggggcgtttagggggcgaagtcccggggggataagggcaccggggcatgtggtgccttaaaggggtctgcgggccgtttgttcgcacgcacgttgat

SEQ ID NO: 80032 - DNA, 1868 bp, Homo sapiens
cgggaaagctgcagacgaggcagggagaggcgggacttcgcgggcgagacgtcatcggggcgccggaggcccggggcgcctgggagtttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggtaaatctggtcactggtcgtggctcttccaaaaatgcttctttacccatggcaggcaaaataaaactttgcatattattatacacttgcttaagaaaagccttcttagtctagaacaataatgaatgagccctttggtaactatgtatctttggacaagtcagtttacttcttttagtctaattgtctgtaaaatggggatgataacagtattgacctcataaggtaatcaagatgctttaatgagataacatgtagaatatttaacacaatgtcttggcacagagtaaacactctgtacttataagcccttattcgtaagccctaataattgtttgactagatattatagttagggtctaggttagaatactaagttctggttgggaattagcccttaagagggctgggaaggaattataagcaaataggccggttggagtggggccccggggcgtttagggggcgaagtcccggggggataagggcaccggggcatgtggtgccttaaaggggtctgcgggccgtttgttcgcacgcacgttgat

SEQ ID NO: 80033 - DNA, 2453 bp, Homo sapiens
  misc_feature (2)..(2): n is a, c, g, or t
  misc_feature (12)..(12): n is a, c, g, or t
  misc_feature (15)..(15): n is a, c, g, or t
gnaacctttganaanccgacagatgggggaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagcacagcttttcttgtgtcctgtattctctgtctaatgtgttgcccaaataatacctaattgttagccattcccctccatctctggcctaaaagtgatagtccaggtatccacatgggctggttcccagaactgccattgctcactctccaaagaggggaaggtggggaaggggaaggtgactatagctcagctcctgagctagtatctggctgttatttcaacaaccggagttggggtttgggctcattttttcccctagccagcaattatggaccagtagtaacacaagtgacagcttcctgtgactgacttcacaattaggaggtctaagattccatttgggtatttgcttaaggatcccacataattgtcccaacggtcattagtagaggggaggtaagccttcattaataataaagagaaagcccacattcaaggt

SEQ ID NO: 80034 - DNA, 2273 bp, Homo sapiens
ggagttcaagaccagcctagacaacatagaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagcacagcttttcttgtgtcctgtattctctgtctaatgtgttgcccaaataatacctaattgttagccattcccctccatctctggcctaaaagtgatagtccaggtatccacatgggctggttcccagaactgccattgctcactctccaaagaggggaaggtggggaaggggaaggtgactatagctcagctcctgagctagtatctggctgttatttcaacaaccggagttggggtttgggctcattttttcccctagccagcaattatggaccagtagtaacacaagtgacagcttcctgtgactgacttcacaattaggaggtctaagattccatttgggtatttgcttaaggatcccacataattgtcccaacggtcattagtagaggggaggtaagccttcattaataataaagagaaagcccacattcaaggt

SEQ ID NO: 80035 - DNA, 1684 bp, Homo sapiens
gaagaagggtatgtgcctgggcaagcaaatttgacagatgtccttggcagaatatgatgttttgaatgaaaattccacataaaggaaacaatgaaaaagaaatataaaatggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagcacagcttttcttgtgtcctgtattctctgtctaatgtgttgcccaaataatacctaattgttagccattcccctccatctctggcctaaaagtgatagtccaggtatccacatgggctggttcccagaactgccattgctcactctccaaagaggggaaggtggggaaggggaaggtgactatagctcagctcctgagctagtatctggctgttatttcaacaaccggagttggggtttgggctcattttttcccctagccagcaattatggaccagtagtaacacaagtgacagcttcctgtgactgacttcacaattaggaggtctaagattccatttgggtatttgcttaaggatcccacataattgtcccaacggtcattagtagaggggaggtaagccttcattaataataaagagaaagcccacattcaaggt

SEQ ID NO: 80036 - DNA, 611 bp, Homo sapiens
cgggaaagctgcagacgaggcagggagaggcgggacttcgcgggcgagacgtcatcggggcgccggaggcccggggcgcctgggagtttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaactcgacttagcagattcaagaaagaagatcaggaaggggcatgacccctgagtgtccaagtgagggaggctcaggtgctgaggatggactagtgctgtgtggtgaggagagcagtctccggaagctcatctgtcccttctccccttcataactcaggggtcatgccccttcctgatcttctttcttgaatctgctctgtgcagcctcacatggccactcaataccggggatcctct

SEQ ID NO: 80037 - DNA, 428 bp, Homo sapiens
tgatttttgtattatgtgaaacaacaatttttgtgtttcttgcaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagct

SEQ ID NO: 80038 - DNA, 1454 bp, Homo sapiens
  misc_feature (1437)..(1437): n is a, c, g, or t
  misc_feature (1449)..(1449): n is a, c, g, or t
cgggaaagctgcagacgaggcagggagaggcgggacttcgcgggcgagacgtcatcggggcgccggaggcccggggcgcctgggagtttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatctggcccataccatagcccacaggagttattggcgaggtcgangtcacatgtagncgtgc

SEQ ID NO: 80039 - DNA, 2706 bp, Homo sapiens
  misc_feature (2)..(2): n is a, c, g, or t
  misc_feature (12)..(12): n is a, c, g, or t
  misc_feature (15)..(15): n is a, c, g, or t
gnaacctttganaanccgacagatgggggaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcagatgggatctctcttacgtcacccaggctggagtgcagctctgtgatcatagctcactgcagcctggaactcctgggcttaagagatcttcttgcctcgggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagcacagcttttcttgtgtcctgtattctctgtctaatgtgttgcccaaataatacctaattgttagccattcccctccatctctggcctaaaagtgatagtccaggtatccacatgggctggttcccagaactgccattgctcactctccaaagaggggaaggtggggaaggggaaggtgactatagctcagctcctgagctagtatctggctgttatttcaacaaccggagttggggtttgggctcattttttcccctagccagcaattatggaccagtagtaacacaagtgacagcttcctgtgactgacttcacaattaggaggtctaagattccatttgggtatttgcttaaggatcccacataattgtcccaacggtcattagtagaggggaggtaagccttcattaataataaagagaaagcccacattcaaggt

SEQ ID NO: 80040 - DNA, 2267 bp, Homo sapiens
cggacgcgtgggtcgacccacggaactaagcgtcttgtagaaggaactattaatccaggagaaacctgtttaatcattgaagatgttgtcaccagtggatctagtgttttggaaactgttgaggttcttcagaaggagggcttgaaggtcactgatgccatagtgctgttggacagagagcagggaggcaaggacaagttgcaggcgcacgggatccgcctccactcagtgtgtacattgtccaaaatgctggagattctcgagcagcagaaaaaagttgatgctgagacagttgggagagtgaagaggtttattcaggagaatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggttagaatggctgaggagcactctgaatttgttgttggttttatttctggctcccgagtaagcatgaaaccagaatttcttcacttgactccaggagttcagttggaagcaggaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttccagattagctggtgctataggcatgcaccaccacgtccatctaaatttctttattatttgtagagatgaggtcttgccatgttacccaggctggtctcaactcctgggctcaagcgatcctcctgcctcagtctctcaaagtgctgggattacaggtgtgagccactgtgcccagcctaattgcagtaagacaaaaattctagggcaccaagaggctaaagtcagcacagcttttcttgtgtcctgtattctctgtctaatgtgttgcccaaataatacctaattgttagccattcccctccatctctggcctaaaagtgatagtccaggtatccacatgggctggttcccagaactgccattgctcactctccaaagaggggaaggtggggaaggggaaggtgactatagctcagctcctgagctagtatctggctgttatttcaacaaccggagttggggtttgggctcattttttcccctagccagcaattatggaccagtagtaacacaagtgacagcttcctgtgactgacttcacaattaggaggtctaagattccatttgggtatttgcttaaggatcccacataattgtcccaacggtcattagtagaggggaggtaagccttcattaataataaagagaaagcccacattcaaggt

SEQ ID NO: 80041 - DNA, 953 bp, Homo sapiens
cgggaaagctgcagacgaggcagggagaggcgggacttcgcgggcgagacgtcatcggggcgccggaggcccggggcgcctgggagtttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggttgcagatattttattccaaactgcccaaaatgcaggcatcagttttgacaccgtgtgtggagtgccttatacagctttgccattggctacagttatctgttcaaccaatcaaattccaatgcttattagaaggaaagaaacaaaggattatggtaaaataaaagtaacataaagcatgaagttaattaatctgtaacatcatactcttagaatttttccgcttctgtgcactaatgttttaccagtcatcttgagttctttaagttgttactgcttgtagaatttataattgttactataagtcaccttcctttttttagacttggggtgaaatgctttgtattgattaggaaatgaaaagtgctttttttggtactgtatctatgaaactccaacattttttttttttaccagcccttccctcatcagcaaaatgttgtaacagcacatactttcccagtatgtttgtatttaaacttcatgaaaagtaatccatggataaaattactctcataaagcagtgtaaacacctcagagagatatttttgtgggttcatggcaatagattatcaggtgacttgctttaaaacccgaaaatttgtccaggcaccatggctcacgcctgtaatcccagcacttttggaggccgaggtaggcggatcacttgaggtcaggagttcaa

SEQ ID NO: 80042 - DNA, 775 bp, Homo sapiens
aaggcactctggctttttaagttctcagggttcttgcactgattctttctcatcgttttgggcttatcttccttcaattttttaggttgctggtgtttggatttttttttctcttatcctatttgataaccttgagtgtttgattctggtataaggtggattcagctgactggcttcatttctagaagattttagggagccaacactcagctcctaactcctggactgtgtgctttaaatatgggagacttgtactgggctgcaactttgttctctgtctcctggaggtcaggaatctactgcactggggatgctgaggttctcacagactgcttctcatcacactcccataggtggtgtcagccaaaaggttctgtgatgtgtgaaaacaacttgggagtagtaatgaagatgaccagaggccagcgagctgaaagtgtttccagcaaagcagccctctgatccatatactttagctacaacttacatcaccaaggtccatattatatactgtgatattccagctgcacagcgaagaatccgtcacctgctgacaaaaacaaatgatgctgagaggtttgggcacaataaagtggataattatacacaggcactttttcccatgcagcattctttaaggatgtgccagaggatcttgaaagatctttgaagagctatgaactgatagaaatacaatcttggatttattttttaatcatttgctagttaataaaattactgctttcaatgtagaattacagcttttaactgatcc

SEQ ID NO: 80043 - DNA, 363 bp, Homo sapiens
tgcttcatgagacctctggtatgatgagttggctcattacatttgctttttttaaaaggaaccctataagacattatcaagagacttttcaatccaatctatttgtgattgcatctttgttttcaaagaaactatttttggaattgttggtttagagttccatctcttagtgtggtcaaaattaactacttagagatactaggcaggatgtaactgagtcagctaatggaactcatgtgttgaagaaaaatttcttgacaaagaaaaaaaaaatggaaggttggggctagaggaagcacccatgggaataataatgtgatttagaatatgccttactacactggcatctgaaaagattttata

SEQ ID NO: 80044 - DNA, 1511 bp, Homo sapiens
tggtacatatacaccatggaatactacgcagccataaaaaaacaagatcatgtcctttacagggacataaatggagctggaagccattatccttagcaaactaatgcaggaatagaaaaccaaacattacatgttctcacttataagtgggagctgaacaatgagaacacagggaggggaacaacacttaccggggcctgtcaggggaggatggtgggggaagagcactagggaaaagagctaatgcatgcggggcttaaacctaggtgatgggttgataggtgcagcaaaccaccatagcacacgtttacctatataataaacctgtacgtcctgcacatgtacccaggaacttaaaaaaaaagtcaagtggttgaggattttataattgattttttagtcttaaaaaaaggaaaaaacaagaaataaataaataccatttaaaaaataaaaaatgcaagtgatagcttgccatatacacagttctatcccttgtgtttttcatgtacatatcttggatgtgatcttactgaatgctctctcattctttgttatagctgcatagtgtttagcagtgtttctgatttctctcttgtctccaacatctactcaattgccaagttatattaatgatgtattatttttcctatggcatctctattcccagtgctgattagtttagactttcacgcctggattgccacaatagcctcctgtttgtcctctccttagcctttcctttatttcatgctattccgttagattcatcttaagtaccgctctgattatgttatttcccagcttagcaattttctccttgcctgcagaatctgatgctacgttctctccatttttcttactgccccctcctccttcatgctctgaactcttaagtcacaccgaagagcctgatgatcctagaacagaccttgtgaattttcacgggagcgttttccatattgttactttaccttgaggtagatgacattgccaccaagtccaaaaccaccccatccttcagttcagctcagacactaactttcctctgaaggcctactgatccccacaattagtccagcaagctaaaagtgagtctggcaaggtgcctaagatacatttaaggggttgctcattctcagggtcatgcaagtgccaacgctgcattcacacaccctgagagtgggtggcttcttaaattttgcctcctcagtgacttgcttacctcttcctagtcccagcctttccttagcagtcctaggcctcctctaaactcccaaagagcttgatttgcacatctctaagggtgttctcttcctagcctgcactgtagttattgaagtacagacttcattttctccccactaagttccttgagggcggcaccacgcctgacccacactggatccctggtgcctctccccgaatctcacacacagcccacgtgtatttgttacagctctttaggttaggactgtctgctcacctgaaaccatgctcaaaggactttcgta

SEQ ID NO: 80045 - DNA, 632 bp, Homo sapiens
  misc_feature (5)..(5): n is a, c, g, or t
  misc_feature (7)..(7): n is a, c, g, or t
  misc_feature (10)..(10): n is a, c, g, or t
  misc_feature (14)..(14): n is a, c, g, or t
  misc_feature (16)..(16): n is a, c, g, or t
  misc_feature (19)..(19): n is a, c, g, or t
  misc_feature (22)..(22): n is a, c, g, or t
  misc_feature (631)..(632): n is a, c, g, or t
aagantnatncttntngcnaanccaaacatccataggactacatactcacagaggtagcaacttcttctgaaggacacctattagcagcctaaactttcctctaagaaacccagcctactcttgtgtcagactgctgaaggcagctacttatatagcctgaatgtttattttcccccaaactctgtatgttgaaacctgatcatgaatgtgatgatgttggagtttgggcctttgggaggtgattgaatcatgagggtgctgaatggggttagtgcttcctataaatgaggccccaaagtcacctggcctcttccatcttctgatgacacagtcagttggtgccgtctatgaatcaggaggcaggccctcaccagacacctgctagtgccttgcttttggattccccagcctccacaactgtgagaaataaaatttctgttatttataagctacccattctattgtattttgctatagcagcctgatatcgtttggctgtatccccacccaaatctcatcttgaattgtagctcccataatccccatgtgtcttgggagggatccggtgggaggtaattgaatcatgggggtgggtttttcccatgctgttcttgtgatagtgaaagtctnn

SEQ ID NO: 80046 - DNA, 321 bp, Homo sapiens
  misc_feature (8)..(8): n is a, c, g, or t
  misc_feature (303)..(303): n is a, c, g, or t
ggaggaanagtgaataaaaaatagaaaataaaaacaatatggaagtattaggcaaaatatacagttacggcaataaattaaaatgtgttgtcccggcacagtggctcatgcctgtaatcctaccactttgggagggaagggttgggcggacacgaggtcaggagttccagaccagcttggccaacatggcaaaacctgtctctactaaaaatacaaaaatcggccgggcgtggtggcgggcacctgtaatcccagctacttgggaggctggggcaggagaataacttgaacttgggagggggngtttgcagtgagccgaga

SEQ ID NO: 80047 - DNA, 524 bp, Homo sapiens
cttaaaatatttcagttaaattttttaatacattatatagcaaacttactgtgccttatatagcagtgtttaaggatcattattttaatttgaatatgccagtgagttcttcatattaagctttttacaatatataatccatgctaaatacatattttggttgtgcttttaacataaatcttaggatgggaaatcatagaaagctggttgcaaatatcagtgggtatttttttaaatttttgagggaatcatttgtgcattataacatgtcttcaatgtgttgtttaattccttttcattgtgccaagatatgtcccattttcttacttagaacacttatatatggaaataaagacattaattcatacattaaagtgatttcaaataaattatatgcactagaacttaacacttaaatatgcatttagcttcttaaaaatacttttattttctgttattgtaagatacaagagtggaggtaggtgcaaggtattgccaacttggtccagtgctcctgcagtctg

SEQ ID NO: 80048 - DNA, 404 bp, Homo sapiens
tgcctgtatttgctaatttttccagaatgggaatttttatttttaaaaaaaggccctcagaggaaacaaaagaaaatgtcagtaggtgaaaaaaggactcaaacgtgacatttttcagaaagtattttttaattaaaaaaaaaatcaccaccgacaccacagactattccctttgcaggtccctgtgcaggttccaaccctagggctcatgaaatcaaattactaggtcaggatcagcatttaagaaaagaatagaatagaaatagcaagcggaaaatcctcaaaattttgaaaagtatgaaaagaaaaaaggctcaaaaacacataaagcaaaatgactacaacctgagaaccagagagtaaggacactggccaaattattattttatttatttatttatttt

SEQ ID NO: 80049 - DNA, 709 bp, Homo sapiens
cactagggggctgcttgtagggggatggaaaaaacggaggcttaaaaaaatcatgctgctgaaatttcagcaagaggggaaaagagagagcgcgtgagagagagagagagagagagagagagagagagagagagacagcaaagcagtcccaggcttcctcctctctttcacgtcagaggcaggaaccgactgtgctaaggctgttggctcaacacccagaggagacgggcagacccagggagagtgagagaagggggtcctctctgacccaaggaattaccactagtggagtgaagccacctgactttttgatcttattttggttgcctcctcattctccttccacccgtagccctgacagcttgggtttcatttctttcgtggagccttgtctcttcctcccagaataggaggaagggaagagaagggaaagaggagggctctctaggtgagcgcatcagctggctccagcctgagcaagcaagaattttcttcccaggaagctcctctcgctccccggccgcccacccccagcctgggtggctgtatcgttttaactgcatagagggcaggtctcttttggaattaggattaaagaaagtgcagtaaagagaaagcatcgaagacaccatcacaaaagattcccacaactccatgctgtgtgctgcaggctggtcctgaacccagatctctggctgagaggatgggg

SEQ ID NO: 80050 - DNA, 1062 bp, Homo sapiens
cactagggggctgcttgtagggggatggaaaaaacggaggcttaaaaaaatcatgctgctgaaatttcagcaagaggggaaaagagagagcgcgtgagagagagagagagagagagagagagagagagagagagacagcaaagcagtcccaggcttcctcctctctttcacgtcagaggcaggaaccgactgtgctaaggctgttggctcaacacccagaggagacgggcagacccagggagagtgagagaagggggtcctctctgacccaaggaattaccactagtggagtgaagccacctgactttttgatcttattttggttgcctcctcattctccttccacccgtagccctgacagcttgggtttcatttctttcgtggagccttgtctcttcctcccagaataggaggaagggaagagaagggaaagaggagggctctctaggtgagcgcatcagctggctccagcctgagcaagcaagaattttcttcccaggaagctcctctcgctccccggccgcccacccccagcctgggtggctgtatcgttttaactgcatagagggcaggtctcttttggaattaggattaaagaaagtgcagtaaagagaaagcatcgaagacaccatcacaaaaggtatttcctgtgaacatttgatcattcatcattcccatggccagtctgtggctttcatatgtaactgcatattcccagggatctgagaccttttgttactggaacaacaccctgggggctagtctccttgaaatgaggtggtcaacagcattagctcctctgggcttcatgcagtctctgaaaaagctggagaaaccgggtaccaaggctttggcttctcataaaatatttctgaatgcatttcatgatgcggttggtaatgaaagtgtgttactgtgctcagtccctccaagaagctagacttgactcccagcctgcctgtgcctgcactgggcccgcatgaatcagtgataaattattcaccagtctcgctctaaaatttctggagttccaaaacccctaataaagtattatgaaaaaat

SEQ ID NO: 80051 - DNA, 482 bp, Homo sapiens
ccagccaaactttttcctagtaagtgaagaaggctctcagcagaaagtacctgtaggccccctcctcccctgggcaccagagaacccagcagcccctcctctaggctggcagtccctggccggagaggctcccatagggcacttgggattcacggagcagggcccagccgccctgctccaggcaaggtgctgggtgtgtttctgacgccaccaagggtgcccatctgccagcactgcaagtgacactatggcgttgtctccctggtggggtgacctggtgctgttttaggctgctgaagtgggtgtgattggcaggctgaacggggtgggctcgcctggcttcgtcatcccccacttttccctgaaataaatcagttcttcatagacatgcaagttcttcacaagccctaaccctgccagctgtcttacaaaaaccccacttaaaatcactagagagttgaacttgtcttggaggcgtcaaa

SEQ ID NO: 80052 - DNA, 488 bp, Homo sapiens
gtatttggagacgacccaagcttgtttaatttctaacctttgtggggaaggggagaggggaaatgaagcatagctttgatccttaggtaatttttgtgttacagttaacattttagacataatttgaaggagttaaggagctataaagaaatttagcagaatggtgggatttggatttgaatcaaaatgatttccctgtgttaaatgagaaactcagcttatttatatctaaagatgtgctttttttcctttctgaaaggaatttcttagaaaaaaattaagaatctttaaaaagaaaaatatagtgacactagtcccaaaatacctcattatcttggaggtttaattatgctcaaatgccttatgtcaacttttttcttttcttttttactaagtaaacaatacatgtggtttaaaatgagatgagctaaataaatgactaatcctataaatttcaaacatttgggggaaaagctctagaaatttta

SEQ ID NO: 80053 - DNA, 457 bp, Homo sapiens
aatgactaaatatcagaatggtgagtgtggagggtcaggatgtctgccaaattggagatgactcttcacttctcaatcttggtgtctcatctggggaagctggagggagacatgcacagcttctcatgaacagtcctggaagcccttaccccaaggcctcatggggctctctccagggcttgctctttgtcactcctttaaaagcctgtcattcattgccagagaacagaagactccatcctaaggccaagttgaaaacggcaggcttgggagctgtctagactctgggtcctggcttttgtcttggctggtgtcaaaatggactctttaaaaactgtcctcaggaagattccccatccaactctgaacagcctggactgatctttttctgatttttaggggtcttgtgaacaagagtcaggtgggcgggcagctcttgtaaagctgaacataacca

SEQ ID NO: 80054 - DNA, 770 bp, Homo sapiens
cttaggtaagaaaattctgaaatgaaggaatattttaaaatacagaaaaagattaagaagtcaccagaaagctagtagttaatcattgaataaaggaacactctacagagaccaaaaactgatgaaacaggctccatcttgctgaatggcgcaagaatgggaaacacaatggaaatgaatcacagatagttgtgaggaggattctttgaaagaaggaaaactctgtttctctatctgtaggatgtcaaatcatgggacataacctgaaaaggaagttaaattttgaacttcaatattattatttccatggtcaaccaaaatttgtactgtttaagagaaagatacaaaagtactgcagcatttgtttaaaatttcatttgcacaagcctgactcttatctctcaagactcggacatgcttcaggcagttaatgactcacaatccactactctagagggtgctgaatctccttaatgaaagaatgtgctttaagattcaatggttaggaagagagaaataaacgagagtaaaacacgaagcacagcagtttttcaaagctagtaagacttctgcgtccaccaaccaactttagctcttacatttttagaaagaaagcactaacacagaaccatgaaattatttttaaaggttctttctaacagggtttcagaggatggtttccaaaaaactcactcagaagtgaaataccacacgttgattttcacgttgcagggagcgcattcctatgcagttcagggattataaatgac

SEQ ID NO: 80055 - DNA, 289 bp, Homo sapiens
agggacataaaggcttacaaaggaaagtgtaccttctgcacacaatacgaaaaaatacataattgtaaattattatgtcaaagtggaaaactgaaatggttattttatcagtgcagttaaaattttaaaaaccctggactgaacgaagaaacacttgaaccccttcagtaggtattgaacacttttctaggcactgtgtaagcacagtggaaataaaataatactttgctcctgctctgacaggtatggtctttgtgggaaggatggtcaggcaagtacatttcccagg

SEQ ID NO: 80056 - DNA, 658 bp, Homo sapiens
  misc_feature (619)..(620): n is a, c, g, or t
ggtttggtccattcagtggtatagacagactaagtgtggccaggcgtggtggctcacgcctgtaatcccagcactttgggaggccgaggcaggcagatcacccgaggccaggagttccagaccagcccggtcaacacgatgaaaccctttctccatgttggtcaggctggtgacccggaacttcttgaagagaacaagggcacacagaggccagggcagaatgctgatgtctgggtagggtgtaataaatactcactgaatgaactcaagttttacttgctggccagggaggaagtagaccgagaaatccctcctacaggctgaacaggggacaggacttcatacgctggctcctgactcagggcatttggatgtcgaggaaggagaagggaaaggtttctgcctcgggggtctgggtcagcctctgtcaacaaggtttacgcagagccaggagaacagagctattgaacaactcacagcggcaggtctgaaggagggagagccttgccaaagctgaagcttccttgttctgagagggccatgtccccaaagctgatgcaaaatcctgaatggagccaagggtacgagtcgaatcgtattgctttttttcacaaaaaannaagtaacaaaaaaaaccatagacaaaaacaaaaaaaaa

SEQ ID NO: 80057 - DNA, 420 bp, Homo sapiens
atccacctgccttggcctcccgaagtgctgggattacaagcctgagccaccgcgcccggcacattattgttttcttagatgtgattttaattttgtttgctaggcaataaactgctgaaataattaaccagcaataattgctcttcagttaggctctaatatgaccactgagcagagcatctaagagacttaaaattgagttactttaggtgtataccattcttacccatttaaattgtagttttaaaggtgggttatgagttggcttgccagtcaaagccttgcttggggtcgtatttctctgtactttcatctttaatcatcagctagattagtcttctggttgagtatagaagccagagagacctaggtttatacaaggagtgctattaactgtgtgtgaccttggaccaaagatta

SEQ ID NO: 80058 - DNA, 325 bp, Homo sapiens
tcaacgaccaaccataagacatagcttcaatttttatacattctacttctgtaaaaactataacccatgctttcagctcctaaactgcctttcatttgccaagttcgaatttagttaactttaatacactccaagaaataatgtagtttttttccttctctgtacatcgtttggcacttacttgaaaattttgagttttgtccttatcttactaaggtgagtggaagatatttttaatatataaaggtactaataactagtgataagaaatataggtttcaaatataaaatgattgggctgaagatagaaatcactaagcatgct

SEQ ID NO: 80059 - DNA, 495 bp, Homo sapiens
ttagttttaagcacaagcagaggaagatgggagcatagagaaggggaaatttctcctgcgcagttagttcaagaattcttcctggagaaagtgacctctgaactaaatgtttagggattctgtaatttactaagcaatacttacaaaaatctgttatgccagatgcagttctaggggctgggattctatagaaaagatctcaactttcataaagataccttctggggaggaaagtgagacactaacacaagcaaacaaataattaaaatcttcagtagtgatgagagtgatgagagctacttaaaatatatcaaggttgtatgattcagcctccattttgctattgtaacatttaagctgatacgtggaagacaacaaagaaataatgagtaggtgaaaggaaatgcatttccaagcttcggaaacagcaacagtaaaagcaaaccaacagtcgcagctagagcagcattaaaagattttatttatttaaaattt

SEQ ID NO: 80060 - DNA, 790 bp, Homo sapiens
cgcggccccaagcggttcccgagcccaggcccgcgccgagcccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagcgttctgtcccgtggtcgggtgcgctgcccctggcacggcgcctgcttcaacatcagcactggggacctggaggacttccctggcctggacagtctacacaagttccaggtggggatggcagtgaccctccaccctcctggcacccacaggccctacagctgcagcgaagggaccaaggtgatggccaagtgtatctctccaagtgctgggtacagcagtagcaccaatgtgctcattgtgggtgcaggtgcagctggtctggtgtgtgcagagacactgcggcaggagggcttctccgaccggatcgtcctgtgcacgctagaccggcaccttccctacgaccgtcccaagctcagca

SEQ ID NO: 80061 - DNA, 909 bp, Homo sapiens
cgcggccccaagcggttcccgagcccaggcccgcgccgagcccaggtcctagagcagctccagcaggatggcggctccagcgtctctaaggcctgcagggggtccagccccatggggggcgccctaggcctccgacagctccccatctgtgctcctgcctgccggccatcctcaggccactcgccatgggcggctgcttctccaaacccaaaccagtggagctcaagatcgaggtggtgctgcctgagaaggagcgaggcaaggaggagctgtcggccagtgggaagggcagcccccgggcctaccagggcaatggcacggcccgccacttccacacggaggagcgcctgtccacccctcacccctaccccagccctcaggattgcgtggaggctgctgtctgccacgtcaaggacctcgagaatggccagatgcgggaagtggagctgggctgggggaaggtgttgctggtgaaggacaatggggagttccacgccctgggccataagtgtccgcactacggcgcacccctggtgaaaggcgttctgtcccgtggtcgggtgcgctgcccctggcacggcgcctgcttcaacatcagcactggggacctggaggacttccctggcctggacagtctacacaagttccaggtggggtgaagattgagaaggagaaggtgtacgtccgggccagcaagcaggccctacagctgcagcgaagggaccaaggtgatggccaagtgtatctctccaagtgctgggtacagcagtagcaccaatgtgctcattgtgggtgcaggtgcagctggtctggtgtgtgcagagacactgcggcaggagggcttctccgaccggatcgtcctgtgcacgctagaccggcaccttccctacgaccgtcccaagctcagca

SEQ ID NO: 80062 - DNA, 1292 bp, Homo sapiens
ggggctgaaagccggaattctttaatcacgtggttagttcctgggcaaggagcccctatcttgaagctatccaggagcttctggcatgcagaaacccacttatcactgtcatttcattagcatacaaaaaaccatttatcactttggagattcccagggttttaggagctgtgtgccagaatactgggactaagactatctatacatactgcatatcttattatacatcacagtgtcataccatctttccaaacctaaaataagaacacagataaacctaaagaattgtcatccaaccaggagtttgagaccagcctgggcaacatagtgagaccccatctctacaaaaactaaaaaattagctgggcatggtggcacatacctgtagtcccagctacttgggaggctgaggcaggaggatcacttgagacctggaggctgaagctatagtgaatccagatggcaccacctcagcccatccttggcaacagagtcagaccatgttcctttaaagaagaagaatatgtcatccaaaagaccaccaggatggctaaatagtagaaggagagctatattggtgatttcagtttgcacagcgggaagagacagtctccagcttatgccaaaagtgctctcttcccagagggaaaagggcagattggtttttatgcctcacagggcctgtatcacacaatagagtaaaacatattcagcagttttgggagaaaagttatacatatctatgagggaagttgaacacacgtgcaatggataaacatatgtaacacaaatcccacgttcactttggggtaaggttttaacattaaaataaggtggaacttggcccttcatgtcaaaaggtgaactattggacacaaagtttgcatgcagtctctataaactggctgacactggctcgaggtcttcggttgcttatcaggaaagaatttttgtaaggctggtcctttgtccaatcagagctatagtggtttggattgtaaatcaggtttggtaaggttctgacaattttcccaatagctcctatttttagcaaatttagcaagattgtgttttttcttgtagccttaggaatttgcgaagttcccatgccaaccaagccctgaaccctccacccataggtaactttcgttttcttaactttagggttcttcttagttgataaaggagcatccattttggtcttccagataacagaacacaatctgacagggcaattatgtgactaaaataatgaaatattaaaaactgaattttccacagaaaaaaaaata

SEQ ID NO: 80063 - DNA, 584 bp, Homo sapiens
aaacccacttatcactgtcatttcattagcatacaaaaaaccatttatcactttggagattcccagggttttaggagctgtgtgccagaatactgggactaagactatctatacatactgcatatcttattatacatcacagtgtcataccatctttccaaacctaaaataagaacacagataaacctaaagaattgtcatccaaccaggtgcaatggctcatgcctgtaatcccagcattttggaaggctgaggtgggaggattgcttgagcccaggagtttgagaccagcctgggcaacatagtgagaccccatctctacaaaaactaaaaaattagctgggcatggtggcacatacctgtagtcccagctacttgggaggctgaggcaggaggatcacttgagacctggaggctgaagctatagtgaatccagatggcaccacctcagcccatccttggcaacagagtcagaccatgttcctttaaagaagaagaatatgtcatccaaaagaccaccaggatggctaaatagtagaaggagagctatattggtgatttcagtttgcacagcgggaagagac

SEQ ID NO: 80064 - DNA, 343 bp, Homo sapiens
aggcaagaggcaagataatgaagtgatgaactgtgggctctaggctaaatggagaattaaatgaagccaagaggtggcaggtgctggacacaactgtgggcagacagcctggggcaatcattctcagcctaggctgcacatccatgtcacctatggagttttgaaaatactgatgcctgaaccaatttaaccatgtctgtaggggtgagacccaggcagcagttgtttcttttttttaagcccttgatgtgactccatagtgcagtcaaacttgacaaccacaggtctagaaagactgggtgactgaagaatggaaaggcctataatcccagcacctgtggag

SEQ ID NO: 80065 - DNA, 409 bp, Homo sapiens
aagcatcttagctaatgacctaaagataagttattctgcttgttatatattcatttatgttgtttgttgaatattgacccatactaatggtgacaatggaataaatggaatgtgggaacttgttcatattgcaaaagtactcattttcagtgagcaactttggccaccttttactgaggaatgagggacctcagagtagacacttgacttacctactgatttacactaggcccttgtcttattgcattttacttttctttttcatccccacccctgctctcatcaccctccttctctcctatagacacccactctaatgaatttgatacttcttaaatatgcatcagtgtaaaaatagttttgtaagtacatgtgtgttcaatttgaataaaggttcttatgccttgtt

SEQ ID NO: 80066 - DNA, 411 bp, Homo sapiens
atgtatggtcttgttttttgaggtcgtctgatgaaatcagaatgatttcacttaaggcaaggcatattaaaatacaaattcgtaaagataataccttgatgtttatgtctatgccaaacttgctctgctgagttcctggtggaatgaaaagactgtctttttttaattgtgatttgtttatgactaacagcatggatttgagacagttatgaaaatgccatggtatcattctgtaaataactttgtctatgtaattgtagtgtatacttattattgacaacttgaagaaagtacataaagtacaaaataaaagttacccatattcttatcagccagatctaactaattttaccattttcatatctctgtgcatactcttaataaaaaatggtataatacatttaagcagat

SEQ ID NO: 80067 - DNA, 409 bp, Homo sapiens
aggaaagatgatagatagatagatagatagatagatagccatagaaaggtagagaaaatgctatattatgaataagtggtaggaaggtggaagattatatagtaaatagcattgaaaatcgcaatataggccagatgcggtggctcgcacctgtaatcccagcacattgggaggatgagatggatggatcacatgaggtcaggagttcaaggccagcctggccaacatggtgaaacctcatctctaataaaatacaaaaattagccaggcagggtggtaagtgcctgcaatcccagctactcgagagtctgaggcaggagaattgcttgaacccagaaggcagaggttgcagtgagcagagattgcgacactacattccagcctgggcgacagagcaaaactccgtctc

SEQ ID NO: 80068 - DNA, 950 bp, Homo sapiens
ggcaggagaatggcgtgaacccaggaggcggagcttgcagtgagccgagatggtgccactacactccagcctgggtgacagagcaagactctgtctaaaaaaaaataaataaattaaataaaaataaataaataaataaataattataccattttttcaaggtccaaactgaatccagagatttagcatttcagcagccctgcatgcaaggaacaaggcaatttcaaatgattgtcttccattcattcaagccaggacatgggatacaggattgtatttcaggtctgcactggaaagtaacggaacatcatttcctttttaaaaaacgggcatctatgccaaaacaacagcttcagctgatgtctccatgaatctaaattcacgtgatccactggttgacctgggtccccgccttccaccacctggctttggttcattgtctcctttcatttctgggctctgtgattggaaacatctgagcaggcggcccacactctggtcctcatcagaaccagtcaatatcctgtgtgtgtgatctggcaagggaagggctggcccggcaccagttgtgttttcacctttcatggctccaactgagttcagcccaagcctacgacccagtcactgggaaaacgtgagcaatgggatctacacaacaatattccacagtcagcagctcctgaacgtgccgcagccacagggcttacagcctcacaataaagcccaggggtagtaaaaagtgagctcgctgttacagaacagtgagtgccacctagcttcactgtcatgggacacacgctgcaggcaaatgcactacttggtaggagattcagcagttctgaggaagggcctccagctctccaggtactgcagcttccagtggttcaagtgtccagtgcaggggcctgcaaagcaaacacgggcaggagaggggctgccagtgtggccca

SEQ ID NO: 80069 - DNA, 1071 bp, Homo sapiens
ttaggtagtccgaagccgactatagagcaataatgcgcactgcatgcgaagctgccgccgcctctagagttactgagaatcaggtatcccctcgccctacccaccccataggcccctagatcagggacgctgcgcggggccggccgcgcagactttctccccacccctccccgacccccacggcagagcccggcggctgtaatggttccatgggcgggggtggggtggttgcccccaagacccctccttcaggcattaatcattcactgaccgttcattgagcacctactatgtgccaggccaattgctgagtccgccaggagcgcagccacctgctgggaggtgtgtttgcaggacaggggtccaaccggcttgggtgggccagggaagaacggcagatgcagagagaccaggtccctaggttcacatgccccctacactcctccccacctcaaccagtccctgctgggcacaactgggctctacctttgagttaggccttttgactccagctgagggggacagatccagggctcctgggcccccacacaggtggccacttctctgatcctctggccaacacacatctgccatgtccagccaggggcagagccatggctggagaagaaggtgccagctgtagcctatggtgtggccagcctcacccccagcagcaagcgtggctgcccccacaaggatgacccaccgctctgcacagcagtgcccacatccaaacaccctacacaaccaggtgtggtgcctgcacagctcccaagctggggcctgcccacctgtgccgcatgcacacgcacacacaggcgcccccacctcaccccaccccatactcctgtctacctacctaaggagaaagctggagggctgtgggcccgtcagggtctcctgcttccccctacaccccgccgccgtggaaagccatgggccccctcccgcccccataactaagcagcacaataaccgacttagcgaattcaggtagaaggaacgtttaggtagcacctattttgtactgattctacaagtagggcccgaggtgcgggggccctcgggtgg

SEQ ID NO: 80070 - DNA, 268 bp, Homo sapiens
taaatcctctgctagtctaactctcctcaccccaccccatactcctgtctacctacctaaggagaaagctggagggctgtgggcccgtcagggtctcctgcttccccctacaccccgccgccgtggaaagccatgggccccctcccgcccccataactaagcagcacaataaccgacttagcgaattcaggtagaaggaacgtttaggtagcacctattttgtactgattctacaagtagggcccgaggtgcgggggccctcgggtgg

SEQ ID NO: 80071 - DNA, 657 bp, Homo sapiens
gtgggagccaaactatgagttttattgaggtgaagctatactggaaaagctttgccctgtagctccaagtggactgtcccatcctctttctagaccttgaggcttacctcaggaggatgatgtttaaatcaacagctgaaagacttgtgagtggtttctacaccatgttaaagagaaggttctaagacagcatgataggcctctaggcctggcctggactctggctcagtgttgcttaccatatgtagaggatgaacagaggttaagcccatcaaggtctgaagtagagcccaggaggaactgaactgtatctggctttcaggatccttttcccagtgtcatcaatcagagaagtcaaacctctgtgagaatgcttgtgcagaggtataacagtctcatgtattggttggcttttgctgcacctttctcattctgttggagggacattggttagtcaggactctgaaggccagctttttcacactgaccaaagcaagtgaaggtcaagcctaactttaatgggaccaggaagtatactcctcccatggaggtggtgggaatggcaccgagaagtttgatgacagttatctaatggactagaggttggcaaactttctgtaaatggccaggttagtaaaatagttctgcttttgaagg

SEQ ID NO: 80072 - DNA, 849 bp, Homo sapiens
gtgtgttccaataagaaaaaaacatggctgtttgcttcggccccagggttgtagcttaccagtcctgtaacagatcacagtttgctcttttggtcacaaatacttgaacccctccctagttcagagcatttgataccgtaatatttaaagctcacttgtaaaacatcgtttgttgcctccatccatagtatctcaaacagaatgtctctcccaaatatacctaaattccatattctctgaagcacaaccagctattttcttgacatacttcctaacacaccccacagttcacaatttgatctgaaaacttgttaagggaggttctttggcatgtgatgccataaaaagagaggtatgggctctcctttaaaaaagagaccctttttatgagactcacaataggataaagagcccatgcctatttttaatcattttttcactatatagacatgcatgctgaaaaatgtttttattagtataatgctaattatactgacttcctatatattttagcatatagattcaaagattattagcacaataaggtagataacttcatagaccatttcttcatcttgttttcatttagtatgtaaaatttatctaaaatttacatgaaagatcagaatagctatgtaatgctactttgtaactcttatattttccaccagatgtcactaatgctgtaatattcaaattaagatgactttcttttggttctaaaggctgtaagcttattggaaaagcaaggttactcagcattggaattcctggcaacaaatatataaatacattaggggaataaacacttagcatttattatttactagtcacttcacatgaattttt

SEQ ID NO: 80073 - DNA, 432 bp, Homo sapiens
atggagagcgggtaagataaagggctattgaaaacccctgaagcatctgactaatgcttattcaagttaggtattggactaaaagatttcagcatccgaaatgaagtataaaattttcctaatgtataaattaatggaacattctcaaatttacaaagtagtacttatgttttaaaagtatagagacttacaatgacttaagtatgaaaaaaattgtctttaaaaaaaaatgttagttttaccctatttggtaattgatgctaaggattttaagagaccaaatttcatcagcctaaaccttccaggttgtatttaaaccatctagctagaagtttattttccataattaaacttctagatttctcttgccacctgagatatacaacttgtatttgggcattttaagaatgcatttttgttttttctctattc

SEQ ID NO: 80074 - DNA, 381 bp, Homo sapiens
ttgagcatatgagcctgttttacagccccctgccccatagcttgtttttttgtagaaaaaaaaacaagtagaaccccatgtagaatgtggtcacctggttggctggaaccagtttatgacagacctcagcaacttatagatggactggtgaactctaatttttaccgtgctaaagtttccaccctaggccaggagcggtggctcacacctgaaatcccagcgctttgggaggcagaggagggaggatcacctgaggtcaggagctcaagaccaacatggccaatatggggaaaccccatctgtactaaagatacaaaaattagccgggtgtggtgacacatgtctataattccagctactcgggaggctgaggcaggagaa

SEQ ID NO: 80075 - DNA, 297 bp, Homo sapiens
attatttttctgtagccctttaaataactttgttatgaaaaatttcaaacatatacaaatctagagaaaatagaataatgatggataccatggatgactagagggagaaaggaaggaggggaacagggtggaaaaactattgggaactatgcaaactctctggctgatgggatcatttgtaccccaaacctcagcatcacacagtattcccttgtaacaaacccacacatgtaccctcttaatctaaaatatgaattgaggctcatgcctgtaatcccagcactttcgaaggctgag

SEQ ID NO: 80076 - DNA, 458 bp, Homo sapiens
gtatccagattgttttattttgcttagacaatcaggtactgggatgaaggatttcctgaagtctttttacctctttatcttatctctttctctgcgtgtgtgtgtgtgtgtgtgtgtgtgtgtgtgtgtgtgtatttagaattatgtctgacacaccgttaagaaccataaagtattagttatcattgttatctcctttaacaaaatcctttcagaaaaatggtccccatgtgctagcatgtgaacccccagggaggccatgcatggtctgtctggttgtctgttcttacgaacctttccaattcagagttgcatgccatgcagggcctcggctgacttgcttattgaagtatgttttattgtatagtgagtgttcattaggccccttggtgccttgtgaaaggagagtggtgggtgcagcctggacaggttctctcacaggagtagcatctctcctc

SEQ ID NO: 80077 - DNA, 292 bp, Homo sapiens
agaaaaaaatgaccttcttgagcaattgaagtaattggtacagtttgaaaaaaataaaaataacaaaacaaaacaaaacaaaaaaacacaaaaagccagtctcaggtgaggcaggtggtgaagggctacgaaacgcatgggtttcaataatgcagtctcctgtcctgtgcctccaaggaggactgtttttggggaggatgtaggaacaattacctggaagtagaagtgtagaagtgaagcttagggagagagcctatccccaatccaagatcaagatcagtggtgtgcaggt

SEQ ID NO: 80078 - DNA, 239 bp, Homo sapiens
ctggaacggagctgctgattctcagtcctgggagttattacgccactctgctttcttaccgagtgaacaatgtcatcagaactatggatgtctcaaagaagtaagaaataagtgtatgaagtagattagttgatttaattactattcatctccctttctcctctcaaggaaatgagttaaggggttgaattaagacaattgtgaggtgtgggaggagcagttttatcttcctgatggtg

SEQ ID NO: 80079 - DNA, 451 bp, Homo sapiens
atgtaactaattattaaagattctcatgaatttttttttttttttgagacagagtcttgctctgtcgcccaggctagagtgcgtgtagtggtgcgatctcggctcactgcagcctgtgcctcccgggttcaagcaattctcctgcctcagcctcccaagtagctgggattataggcacgtgccaccatgcctggctaatttttgtatttttagtagagatggggttttaccatcttggccaggctggtctcgaactcctgacctcgtgatccacccaccttggcttcccaaagtgctgggattacagcgtgagccaccacgcctggccgattgtcatgaatttttatcctcaattaattgtgtaaatgtgagtgcatagtaactcatatgctagagactaggaaaataagttagaaaagattatctaaatatattctgtgttgcaaaaaaa

SEQ ID NO: 80080 - DNA, 804 bp, Homo sapiens
cccttggagaggatatctggggaaggcctctttgaggaggtgagttgtgaagggacaagaaagagacagccatatggacactggagttaagactatcagtcacagtagcgactctggttttctcaagttcatattgttgtactgtaagagcagaggcattctaactttccagcagcttccaagtggaagagtttttattgccttggtggctttccttaacaattgaacagaaccacaagggagaaagacctttttttcagggaagctggggtaggtagagttggcctctgacctaagattttgtccagtgacttttctgttggaacggaatgtctaagaaaacccaaggaagaagtgaagtctctaagaaatgtcaggcagaaatcacccgggggcaaaatccacctgaaaatgttgattagcctctccctttccctctttcatccacatccttatctctatatactcacatggtagaaggtcagattgttttccttaagaagaattttctcatgtaaaatattaatgcaatctgaattgcataattttaccatattctattatctgaaattagttataataattcaatgctttcaccccataccacataaatacaaagcattttttcttagtgggtggaatggtgaaccccaaaatgatatgttcatgtcctcacccacaaaaactgtaaatgtgatgttatttggaaagggagtctttgcagatgttactaagttaaggatcacaagagcatactgatttagggtgggccctaaatccaatgacaagtccttctaagagaag

SEQ ID NO: 80081 - DNA, 475 bp, Homo sapiens
gctgagatatatgggaatcttaccctagttttgccattttctcctaacatcagtctacttcttttaatattcattgcttctccccatttctgtagttcagtgcatgttcctttcctctgcaggaactacttctctttcctcacccaactcataaatctctgcctcccaccctaagggtaggcacatgacccaacctgggagatcagaatgccacacccccaatacaggattggtttgtgagtaggcagatgattctgtccatgcacagaactaagtagaagagagtttttacacctcagcttagcttgatgctagcagagagctactggagttctatttcctcctctagggaagaaaaggattttggtttggagataaagccaagataccaagaaagtgggaatgaaagacttagagacagggagtcctggccccttttcagatgctcagatgctggcactagcttgaggcccag

SEQ ID NO: 80082 - DNA, 1465 bp, Homo sapiens
  misc_feature (3)..(3): n is a, c, g, or t
ggngaggggtagagtgagaagcaccagcaggcagtaacagccaacccttagccattgctaagggcagagaactggtggagcctttctcttactcccaggacttcagcacctaagacagctccaaaacaaaccagaacagtcagctccgggggagcacgactgggcgagaggcacagaaatggacaccagaaataaggcccagctccttgtgctcctgactcttctcagtgtgctcttctcacagacttcggcatggcctctttacagggcaccttctgctctcaggttgggtgacagaataccctttgagggagcaaatgaacctgatcaagtttcattaaaagaagacattgacatgttgcaaaatgcattagctgaaaatgacacaccctattatgatgtatccagaaatgccaggcatgctgatggagttttcaccagtgacttcagtaaactcttgggtcaactttctgccaaaaagtaccttgagtctcttatgggaaaacgtgttagcagtaacatctcagaagaccctgtaccagtcaaacgtcactcagatgcagtcttcactgacaactatacccgccttagaaaacaaatggctgtaaagaaatatttgaactcaattctgaatggaaagaggagcagtgagggagaatctcccgactttccagaagagttagaaaaatgatgaaaaagacctttggagcaaagctgatgacaacttcccagtgaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactca

SEQ ID NO: 80083 - DNA, 1588 bp, Homo sapiens
  misc_feature (3)..(3): n is a, c, g, or t
ggngaggggtagagtgagaagcaccagcaggcagtaacagccaacccttagccattgctaagggcagagaactggtggagcctttctcttactcccaggacttcagcacctaagacagctccaaaacaaaccagaacagtcagctccgggggagcacgactgggcgagaggcacagaaatggacaccagaaataaggcccagctccttgtgctcctgactcttctcagtgtgctcttctcacagacttcggcatggcctctttacagggcaccttctgctctcaggttgggtgacagaataccctttgagggagcaaatgaacctgatcaagtttcattaaaagaagacattgacatgttgcaaaatgcattagctgaaaatgacacaccctattatgatgtatccagaaatgccaggcatgctgatggagttttcaccagtgacttcagtaaactcttgggtcaactttctgccaaaaagtaccttgagtctcttatgggaaaacgtgttagcagtaacatctcagaagaccctgtaccagtcaaacgtcactcagatgcagtcttcactgacaactatacccgccttagaaaacaaatggctgtaaagaaatatttgaactcaattctgaatggaaagaggagcagtgagggagaatctcccgactttccagaagagttagaaaaatgatgaaaaagacctttggagcaaagctgatgacaacttcccagtgaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactcagaatattgctttggtcatatgagcttccttctgtgaaatacattttggagacacaactatttttccaaaataattttaagaaatcaaagagagaaaataaagaccttgcttatgattgcagat

SEQ ID NO: 80084 - DNA, 202 bp, Homo sapiens
tggctattaaatagctacaatatgagttaacatcccttatgtagaagtataaaccattgctaattagagtaacactgaaaatacaagtttacatttaaccaaaaaaaggaacaccatgactgatcccatgttttcactgtttcagaatgtggaatctttaagcaactacaggcttacatttttctcttaaaaaaaaaaaaag

SEQ ID NO: 80085 - DNA, 541 bp, Homo sapiens
ctgaagctatccaataccctggttgtcagtgactgacaagcagccacatctgtgctactgctgtgccagtcatccaaggcacagatgccacctcttccacgtcacatccttccatctctccagatacttccatcaccctcaggttctttgtctagttcccaatttggctctgtgactacccagccacctgcctttatttgacatagagatgaccgtggctctcactgcagttctcactgctcattctataatgttcatcattcctttggatttctgtccaactgctcattctctagcccctaaacaattccaatcttctctccaggccaccaccaactccaccagacacctaaactagctgaaataccatcaaaaggaaaaaaactgtcacttgttcacatgacagggataacatggggaaaaacagcatgagagttttaaaaaggtgggaaaatggaaagactcaaatggcattttcttacctagcatttgcaagtggattcaattaggagaaaaagcctatgagggtcattaacaattt

SEQ ID NO: 80086 - DNA, 203 bp, Homo sapiens
ttttttttttgtagagacaaggtcttgctatgcccaggttggtctcaaactccaggcctcaattgatcttactgccttggcctcctaaagcactaggattacaggtgtttaattgtgatgttctatgccaccatcaaactgaaggcacacccatccacttccactattatgactttctatccaatgtccaatcaccttccttc

SEQ ID NO: 80087 - DNA, 453 bp, Homo sapiens
ataaataaaattgcggccgcgtggaccttgaaaagacaggggtctcaccgtgttgcccaggctagtctcaagctgtcctcccgccccagctccccaaagtgacggtattacaggcataagtcaccactcctgccccagagctgggttttgaaggatgaagagtgatatgccagacaagggagagaaagggaatttcttgctgaaagttaacacaaaccttatgcaaaggcataaaacaacttcctatgtaaatttttactttttaaagatgaggtctcgcctgtcacctaggctggagtgcagtggcgtgattgtagctcactgcagctttgaactcccggcctcatcctctcgagtaactgggactaaaggcacacaccaccttgcctggctagaaacagattttcatctgtagaagacaggaagccaataaagagttttaagcactggtga

SEQ ID NO: 80088 - DNA, 854 bp, Homo sapiens
agtgcactgaacaccagctgctctcttcctctctggctcccatggcagccatggtctgttgcagagagaagaggattgcctgttccctctttaagggaacctccgttttgctttctggaaccactctcttaatgccgcctgtcaaaaccagctaggactccctggggtccaatccctctgtgtttaatcttctgtcatctctgtcccacctggctcatcagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccaggtagcctctattttccttgtgtctcatacctctgtctaggctatggaagatcaattctgaggacaggctgtatatacacatattgttattgttttagtcagaaactaggatggagctaggtgctgtgactcacacatataatcacagcactttggaaggcccaagtgggacgatgacttgagttcaggagttgaagaccagcctacacaatatggtgaaacccatctttacaaagaatacaaaaaattaggcaggcatggtgctgcacgcctatagtcccaactgctcaggagacttaggtgggaggatgggctgagatgatcctcccactctcattcacttctgtcaggctagactctctctccttttcattggcttgtcttagctattaataagtctcggctgggcgcagtgggtcaca

SEQ ID NO: 80089 - DNA, 396 bp, Homo sapiens
cgagtacctcagttttcaattcaattgggaacagcagtggttccctaatttgattccataggcttcttcagaatcctctggagtaattacagatactcacatagattggcaagtgccatctctagaggcagaagctgggaccacaggtgcctgccaccatacctggctcatttttttatttttagtagagatgaagtcttgctgtgttgcccacactggtctcaaattcgagctcaagccaccctcctcgcttggcttcccaaagtgttgggattacaggcgtgggccaccgcacctggctagctcagctttttacagtaacaaaataaattggaaataatctaagtgtctgacagtaaccacgtacttaaaccagttatgctttagccacatggt

SEQ ID NO: 80090 - DNA, 482 bp, Homo sapiens
ggctgaggtcctcttccacactgtggaagctttgttcttttgctcttcacaataaatcttgctgctgctcacgctttgggtctgcactacctttatgagctgtaacactcattgcaaaggtctgcggcttcactcctgaagtcagcaagaccacgaacccaccagaagtaagaaactctggacacatctgaacatctgaaggaacaaactccagacataccatctttaagaattgtaacactcaccacgagggtctgcggcttcattcttgaagtcagtgagaccaagaacccataggcaggaaccaattctggacacagttagacataggaagagtgtttcctgggtcgtaagtgaaaattttttatttcatagaacaatttaaagccaaaagcacagaatattatgttggaaggaaacatttcctttagacctttaagagaaaacatttttagcatcagaccacaacagaacccgaaaaa

SEQ ID NO: 80091 - DNA, 394 bp, Homo sapiens
tgctgctgtgaatatgactgcacagatagctgtttgcatccctgctttcaattcttttgggtgtgtgcgcacaagaggaattgctggatcatatggtaattctatgtttaattttttttcacagcatctggaccattttacattccccctccactagatatgttattatatacaaaggtggacggctatacaaggacattccctacagcattgactataacagtgaaatatgagaagccacttaaattcaatagaataatgaaatagaatcatatagatctatgtacacagataagggaccatctatagtacattctgttaagtaaagcaagcaaagtgagctgggcacagtggctcatgcctgtaattctagcactttgggaggctgaggtgg

SEQ ID NO: 80092 - DNA, 341 bp, Homo sapiens
gtttggaaatggttctccaaccaggctacaaatcaggatcaagtgggaagcttcaaacaaacagaggccaaagccttatgcttagaactcttttattcagttggtctgatgtgtagccaaggcaccagtgttttttttaatgctttccaggtgatttgattgtaaggtgcagcagggctgagaaccactatttagggaagcaacagaagtaatgtattctaggccaggtgtggtggctcacacctgtaatcccagcactttgggaggccgatgcaggcagatcacctgagattgggggttcaagactagcctggccaacatggcaaaatgctgtatctact

SEQ ID NO: 80093 - DNA, 346 bp, Homo sapiens
caacacattcaaagccaaaggacttagagtgaaatcttaaggtgtttgctaccataattctaatttggtattcataaaaaattatgtaatatttcaagacttaacgtgctctgtttgaatacacacatcaaaactctgtggttgctttcttttttccacttgagaaactaaattaatttaaagctagtttgtggaatataattgaacactagttattttaatttccttgctacttgatcaagatcttgctcttttaagcatcatgtgaaaccgttagtacccactttcacctggcaaaataaggcattttacatgatcagggcaaatatttttctgactctgatga

SEQ ID NO: 80094 - DNA, 839 bp, Homo sapiens
tttttatattgttagtagagatgcggtttgactatgttggccaggctggtctcaaactcctgaccctgtgatcctgccaccttggcctcccaaagttctggaattacaggcgtgagccactgcgcccagcctctatggttattatattacaaaaacagcacaaaaactatatattttttataatactcaagttgtttgacaaagatactcatcatttgcaacattattctgtaatttttaaaatatatttgttaattgacagataaaatatcctgtagaatatggtgttttgtagtatatatacattgtcaaaagcttaattctagctgcttaacaaatacttcaccacacataattacttttgggataagagctcataacattgactgtgttagcattttccaaaaatacattattgttaactgtagtcaccatgctgtacaatagatttcttgaatttattcctcctaggcaactatgtgttgttttacagacatgtctccagatgcccctttcttgtaaatacccaagcatctggtaaccagcattctactctctggcttatttcacttagcatagtgtcttccacatttatccacattgtttcaaatgaaaagatttcctcccttttaacgttgaattgtatttccttgtgtataccacgtttttggaaaaatacattcatttcttggttgaaaaactcacgtgatgagaagatatttctgtattaaagcatgtattggaattccgtatatacatgttttagtaatagttgatttctaccaaatgctaaccataatactgtatatgtgttaataaattttattttcggccaggcg

SEQ ID NO: 80095 - DNA, 652 bp, Homo sapiens
tgcatcccccggtctgtaagaattccgcatttcacacgtgtgctccctgccctgctcctggccccttggccggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggcctgcaccgctgtctggcctgcgcgaggtacttcatcgattccaccaacctgaagacccacttccgatccaaagaccacaagaaaaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgcccccaataaaggaactggacaaagagaa

SEQ ID NO: 80096 - DNA, 662 bp, Homo sapiens
gcgtggcctgacgtagctgatcggcccggaagtgctcacacgtgtgctccctgccctgctcctggccccttggccggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggcctgcaccgctgtctggcctgcgcgaggtacttcatcgattccaccaacctgaagacccacttccgatccaaagaccacaagaaaaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttgatgtgacagggaagtgtacagactaccctgcccccagagagtggaggcggcaaaagcggggcaga

SEQ ID NO: 80097 - DNA, 173 bp, Homo sapiens
gctgggagggagcgtgccaaccccttttgcctctgggtttggggagcggagggcctcttcttggtgccctgcccccaataaaggaactggacaaagagaacttgcctccaactctaacttccaggccgctgtctcaaactcctgccctggaagggcttctctactactttctg

SEQ ID NO: 80098 - DNA, 656 bp, Homo sapiens
gcgtggcctgacgtagctgatcggcccggaagtgctcacacgtgtgctccctgccctgctcctggccccttggccggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggcctgcaccgctgtctggcctgcgcgaggtacttcatcgattccaccaacctgaagacccacttccgatccaaagaccacaagaaaaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgcccccaataaaggaactggacaaagagaa

SEQ ID NO: 80099 - DNA, 798 bp, Homo sapiens
gcgtggcctgacgtagctgatcggcccggaagtgctcacacgtgtgctccctgccctgctcctggccccttggccggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggcctgcaccgctgtctggcctgcgcgaggtacttcatcgattccaccaacctgaagacccacttccgatccaaagaccacaagaaaaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgcccccaataaaggaactggacaaagagaaaaaagcacaaacaaaaaaaaaaacaggctccagagaacgagaggtgcgccacagggtctcgtcccgccgcgggacgcgcgcccgggaagaccagggacgcctgggcctgtgccgaaacaccggccgccgccgtccacaaccc

SEQ ID NO: 80100 - DNA, 402 bp, Homo sapiens
aagaattgcctgaacccaggaggcagaagtggcagtgagctgacatcatgccactgcactccagcctgggcaacggagcaacactctgttgcaaaaaaataaataaaataaaatttaaaatgtaaagtttattgtgataaatgcctaaggaatatatcttaaataaaaaaactcattttatacatcaaggagctagaaaaagaataataaactaagtccaaggttagcagaaggaagtaaataataaatattggagcagaaataaatgacattaagatagtaaaacaactgaaaagatcaatgaaactaaaagtttctttgaaaggctaaacaaaatagataaaccaagagctgttttttttttgaaaggataaaataaacctttagctagattaaccaaag

SEQ ID NO: 80101 - DNA, 624 bp, Homo sapiens
agatgtcggagtcatcagaactgatacttgacagtgagagaaggaatcgattttcccagagttcaaagtagaatgtgacttttaagaggtttcatggtttttgtgaattccatgaagttactaagtaaaagctgcaaattcatcataatttttctcaacattcaacactcctacttgttaatccaacaaatggtagataaaagtctgtattctaccatgcctttcaaaagtttttattatctgaaagcatatgaagatgatatttatgtatatttaatatgtaggggtattattacatattatcagtgaaatacgagtataaaaattagggtcaaccagaaatctgcaattgactgtcaaaactgagctcagttaaagtaagattcaattctaacatggatgtgcacgttcctaaatatcttatgattgaatatttacatgaaggcattcatttttatctgcccctttatcagacctatttgcatctcctcaaatgaattagatgtggcctatgctttgcagaggatggacctcacctactccgcacaccgtgaaaaaactggaaatgggcattgtagtctttaattaataaaaacaccaaaaatgtgtattgcctttcttaac

SEQ ID NO: 80102 - DNA, 444 bp, Homo sapiens
tttggctattgtggttcttacgagtttaaggaaggcattattggttggggggcggcgggtgggaatgtattatggtagcttgttttagatgctcttacacttcatatatacaagaaactaatgagattggttctctgtgaaggatcggggacaaggaggtgggaggatggggagggagtgtgcctttggcatggtttcacttttgtatggttttgagtcatgttaatgttttacatattcaacaagcaaaccaaaaggacagggacaaatgtaaaactgaaaagaaacaaacaaatgctctaactgcatttcaaatgaataacataatcacattgaaggagggaaaatggatttcagtaacgtttgtaccggatataccctcagtctaatgaagaaacaaaaagaactgcaaacaaatcttaaacatttcttcaaggtttagtt

SEQ ID NO: 80103 - DNA, 621 bp, Homo sapiens
cgtctcaaggtatgtttcatgtatcttctcttttttcattgataaaggcccaaacttcccagagagaaaaacatacagccttaaggaatttggctagaagtctattcagggcatatgatacgatagaacagggattctgtagaacctggaagaaagtagtcactctaggagtaggttagcttgagagaagtagcaagaatgtacttaaagcagcagataatgagatagaattggggtaaattgcggtaggaatatgttagaagcaagggtggaactgtcgtcactgttacctcgatggcgaagccagaatgtgaggctcttgctcttagaactcacgtgagtaccatagcctcgcgttgtcttgcaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggtgagcactgattccaattacgtttttatttt

SEQ ID NO: 80104 - DNA, 301 bp, Homo sapiens
cttactcagtttggataaacccctctttcttcttcagtcacaccctagctatactgcctacctagcacctttggatttgcatcttattctctgcctgttatgctctttgagccctctatgactccctttctcacctcatatctgttcaaatgttaaattctcattgaggggttccctaattacctataagatattttttcaactcccctactccttctctctgattttctccctgatttcttctaccatgatatataaattggttatttattctattgcaagataaactttatgaagacaa

SEQ ID NO: 80105 - DNA, 449 bp, Homo sapiens
ttgagacagagtttcactcttgttgcccaggttggagtggctcctgagtagctaggattacaggtgtcctctaccacgcctggctaattttttgtatttttggtagagatggggtttcaccatgttgaccaggctggtctcaaactccagacctcaggtgatccacctgccttggcctccaaaagtgttagattacaggcgtgagccaccgcacccaacccaacatcctatattttatgtaaatattatactatggaccgacttgtgtctcttcaaaatttatatgttgaagtccttaccccctgtacctcagaatgtgactgtatttggaggtggggattttaaagaggtggttatggtaaaatgaggtcatatgagcgggtgcttatcaaatatgatataagccggggaaatctggacacagacatgcacagagggaaagcatgtgg

SEQ ID NO: 80106 - DNA, 156 bp, Homo sapiens
gccgtgggaaggagaggagaggaggatccttgtaacttgctggtggcccaggtgtccctgctatccgtggacgaaatgtaccagaaccttccccccgctgagaaggaccagtactgggatgaggaccagccgcagccaccctacactgtggccacg

SEQ ID NO: 80107 - DNA, 295 bp, Homo sapiens
gataaaatgcaaacacaagcctgtggtacacattctgtatggttatttaagtagtttaggggtattttcaagtcaagaacagactacttatgtataagtaagcacagtctatattgtgccaaactattttttaaaatacttaaatttaaattacttttcaaaggatccaaatcataggtattaatattgacattgtcttgcatagattaaaacgtatcatgttgttaaataattatacatatctaagatatttttatttttttttgagacggagtcacgtgtctaagatatttta

SEQ ID NO: 80108 - DNA, 203 bp, Homo sapiens
cttctcagtagttcagccaatgcgatgaaatgtgaagaagccttccccagcttccttgcattctctccatcatctgtgcagtggagagtagttcccactgctgtggaaacattttccctttgctcttttctctcagggcaggctttcctgagtgcctgctctgtgtgagtcatcgtgggaggatgcggtggagaaggacaggg

SEQ ID NO: 80109 - DNA, 738 bp, Homo sapiens
  misc_feature (419)..(419): n is a, c, g, or t
gcctgtaggtttacttgctacattatcttgatagtgccaatgagatctgtgccactaaaattaaaattgggccaatagcatataattaaacacattttgttgtaaaaacatgatttagataagtgctataggctatttttttcttttctttgagatggagtctcgttctgtcacccaggctggagtgtagtggcacaatctcggctcactgcaatatctgcctcccatgtcaagcaattctcctgcctcagcctcccaagtagctgggattacaggcacatgccaccatggccagctaatttttgtatttttagtagagacggggtttccccatgttggtcttgaattcctgggcctcaagtgatgcgcccacctcagcttcccaaaatactgggataacagtcatgaggccaccatgncccggccactataggctatttttaaaaaaattttttgtggaggcaaggtcttgctatgtggcctaggctgatctcaaactcctggcctcaagcagtcttccttcctcagcctcccaaagtgttgggattacaggtattagccaccatgcctggcctgctctaggctcttaaaatgtactttcacataaaaggaaaaaataacacttcttgttgccattgttatatgtgtgttttacatattgtcaaggtcttaagtgatgaacatgaatttgtaaattgaacttttgaaataataaatttcagttaatgaaatatatat

SEQ ID NO: 80110 - DNA, 355 bp, Homo sapiens
tccattcttcaggtcagagcattgggccactggagtagtctgggaggggcctttgacttctctgcccctaaaagtgagttctcataaaatatggtgcgcccaggctaacgctggtacttattatggcaaatcctttagcttcaggtccctgctctttttgtcctccacttctgatatgacaaatgcccaacagtggaggcaggaagacagcccaccttctgtcagagcctactccccagctcatgtttctctgtccctccgttgtatagcaaactcttgccaagccttttggaatgactttttaacaagaaaagccccatactttaatgggccaattcaaacaactgacatctgt

SEQ ID NO: 80111 - DNA, 404 bp, Homo sapiens
ttaagattacacaggcatgcacattttcactgacaattgaaatttatttgctttacatgacactaagttgttctattaataactaagataccaaatataatttagaaatacaaaaaaagaggatgggtgcggtggctgacgcctgtaatcccagcactttgggaggcagaagtgggcggatcacctgaggttgggagttcgagaccagcctgaccaacatagagaatccccgtctccactaaaaatacaaaattagccatacatggtgatgcatgcctgtaatcccagctactctgtaggctgaggcaggagaatcacttgaacccgggaggcacaggttacagtgagccgagatcgcacccttgtactccagcctgggcaacaaagagtgaaacttcatctca

SEQ ID NO: 80112 - DNA, 752 bp, Homo sapiens
agcggatagctctggctaggacctccagtactatgttgaaaaggagtggtgagagtaggctcttcgtcttgttccagttctcaaagggaatgctttcaccttttccccattcagtattatgttggctgtgggtctgtcatagatggcttttattacattaagactcagcttcgcactccagggctgcgtaccaccagccactgtcatgttaaccccttcccaggccaatgtgtccttggtctggagcccaatctgctggacagcctgggaccgtccattttcggggtggtgggcaacctggtggccatcgtggtgctgtgcaagtcgcgcaaggagcagaaggagaccaccttctacacagttatgcggctggttgccaccgacctgttgttcactttgctggtgagccaggtgaccatcgccatgtacatgaagggcgggtaacctgggggccagctgctgtgtgagtacagcatcttcagcttgttcttcttcagtcagtccggcctcagcatcgtctgtgccatgatatctatacaggatgtctcaactcaaatgtgaaattttcatggagaatatttgaactgtatttagattaatacaaattgcagttaaaaagtttaatatagatttaccagggggcgtgcagcccgcttgccaatcagatcgctgctgagcggtcccacagccaacccccgaagagcagcctgctggcttccccagtgcccaggagttggggatgtcctacaaac

SEQ ID NO: 80113 - DNA, 863 bp, Homo sapiens
cctgggtgagcgccagacgcctggggtccgtttgccgcctgctgagactagacaaggaccccgggagggcgacgttgggggagagggctacggatggaggtcccgccgcgcttgggccgggtccggagccaccaggacgcacagcgggtttccctcattctcagtcaggtggttgagttatccaagccttcataaccagagggtctgagcacttgttggactgtgcttactgcagcttctcatttacaattaccactgcacctgagagtaccaagagattcctgagccagagattacgatttccaacttccagctcctcaagatggagaaacagagggaagaagagacttggaatcactctgtcctggctgtgggtctatgaaaaagaatgtggcctactgctaaatacattgattttgaagctagatagctctggttttggggagcaagtgatttgatctctcagagactcagctacttcatcagtaaacagagattaccatatccaccagtaatggctataggagcagtaatagggatgatataggtgaaagcactgatcactgaatgattccaaagacaggtgcagagaggttcaggcatcagacaggctacctggatccaaatcccagctccatcatttactactttcatggcctttacaaaccactaaacttctctctgagcttcaattttcccatctgtaacatgggaactaataaaatgaaaccttcctaataaagttgccaggaagattcattgagacattgaatgtaaagtatttaactcaatatagagcacaggggagcaccaaataaaattcaggtgttacatttttaagcacgtgttcaccaaggctccca

SEQ ID NO: 80114 - DNA, 764 bp, Homo sapiens
gtaaaataaatatataacacagaaatacatgagaaaaaaaaactaaaacagtccaaaatatctgcagtcacgaaattcacagttaacgtttcatcttccacctcccacatcctccgcccctgccacctgcctccgactgtcattgggattacaaaacccaactggagccctaacagtgcgctcttctctgaagtacttgaaagacgtttatctccagtacaatataaataatacaaatagttgtacttcaataatcactcaagaccacctcctgagaccttgtctgagaaacagagaaaaaaagaacaaaagtctactaccaaggagctcctttattctactggcaattccacatgacctcttgtcacttaacaattgtaacagagagactgtgacatacatgcaggcctgacattattaaccatcattcagagcacaccagacaccacagaaataaatgctcttctgttgtagttgcaggtatgaagaacagctggaaggaaatttggtataatgaaaagaatactaatcccacgaatctggaagactgactgccagtcctttttctgatgtcaaaattactgtcttaaagacaatccactcatttttatagtacctgtagaaccctgtgttcaaagacatgctgtaaaagatgtaaaattagtaatcaagggcctgctcctacttggtgaatggggaaggcggactgaacctcgattatttctaataacacaactggttccctgtacatagtgaagtccaaa

SEQ ID NO: 80115 - DNA, 423 bp, Homo sapiens
gcacaagcatatgcatatgctaaatatcaatgtccagagttttaacattttgacattttttatttaaacttgtttttaccttatttagattatatggtagagataattttatgccctcctttcttaacattatcataagcatttttcttaattgtttagttatgcattgtgtttattacaaaaccagcatggaatgctgatgtgaacagtagaataaaatcagactgtgtaccacacctgactccgccattaagtatttgtcttttttttttttttttttgagatggagtctcactctgtcgcccaggctggagtgcagtggcgcgatctcggctcactgcaacctctgcctcctgggttcaagcggttctcctgcctcagcctttcaagtagctgggactatagtcgtccgccactatgccc

SEQ ID NO: 80116 - DNA, 550 bp, Homo sapiens
ccagcatgggaaaattctggcaaacaatcttacaagcagagtaagtacaagactttgaagcagcaaagatcttacacaatccatcgtggttggagcagtaagagttaagaatacatagatgagagaagagaagagaagaaaggcagatattgcaaggtctggaaggccaagataaggaaatgaatttcacctcattttaaatgtagtaggaagccaataagccaacaagaaattttaagcagagaagtgagatgttctcatttatgtttccaacagttcactctgctgtgtacagcgtggactgggggggaagagttaaagcaggaaaatcttcaactagggtggccccaatggattacagaaacttcaatgacctaagaatagtttggtagaagcaatggactttgccgataaaatgaatgttgtggtgtgtgagggcaataagttaagaataactcacaggtttctagcttggtcactgggcccaaggtattgtcaatttctaacttggaaggagactttgaagaaaaaatgtttacaggatacaaat

SEQ ID NO: 80117 - DNA, 947 bp, Homo sapiens
taatgtttgactctaagagcttaaatacttggcaaggttttcctaggagaatttgtggagaaaatctgtgaatagatgagccaatttttaaataatataaaatggggatacatgatgcaaattaattcttgccttttagtcccacatcccttcttccattacttacaggttattgttaccattaagaacacttctttttcttaaatgagcaggtttatgtcgattattcagagttgttacacaggacatagattggttttatcatgtctatcttaaagtttttctttttcttactcttaccagtcaacctaaaattcttttttccctctgatatctaattgcaggttaagcaacctgaaattcttgcaaaagggcacctttaatttgaattgtaattggaatcctatgctagtgacagtgtatggcttttctgtattgttttctaataattatttgaatatgaaacattccacagtaaatcccagacaagagctattgtttttcattttataggtgagagattaagtaacttatataagattatacaactggtaaggttggagctagtattcaaattctgataaatctggtacaaaagtacacattcttctgtaatatttaaatgtgaattctttttgcagtttttgagtcagagtcttgccctctcccccaggcatgagtgcagtggtgcgatcatggctcattgcagccccagcctcctaggctcaagcgatcttcctgcctcatttttaaatttttcatggagatgatgtctcattatgttgcccagcctggtcttgaactcctgggctcaagtgatccatcccaccttggcctccgaaagtgctggaattacaggtttgagccaccatgcctggcctaaatatgaattattattattttaaatggagcctgggcaacaagagcgaaactctgtctcccattta

SEQ ID NO: 80118 - DNA, 597 bp, Homo sapiens
ctgttgcaaacaggctggtttgtaaaagatgtatgttttggtgtttgaaatgtttataaaattgtatataaatggtttcaattttccaggcttttgtagatactatatttgatgcctatcaggatgctttaatttggggggtcgaatataattgtaagtcatccacgctgttggtctgcaaacttttgaggtaactacacacacacacacacacacacaaggattttagatttgaaaatgatgttttttactcatttcaaaatgtactgtaacctttctttggttcttactgttttcatttaactttctctgttttcaagaaaaattgtctttattgacatttgtaaaaaagaatgtgttttgcccagttattaagtattttatttttatgcaatttcagaatcacaatgaggtatgccatttcttcatatacatgcacattcacctcaacttgcacacacatcacacaccaaaccttatgcaaaggggaaagctaacacttagagtggattttgtcccttaaggaaatggattgttcctgcatatattgctggtggcagtattcagtcttgtgttctttttctaaaaaaaaagaaa

SEQ ID NO: 80119 - DNA, 167 bp, Homo sapiens
ctacaaacagaaactgtataaccattaagcagtaactcttcatgcttcccacctccagcctctagtaacctttaatctcctttctatctctttgaattagtctattctagacattgcatacaactgtacggaattcttttgctttttacggggggggagatgcttat

SEQ ID NO: 80120 - DNA, 336 bp, Homo sapiens
aaagatgggaaaggatcaaaagaatatgtcaaataaagatgtgcaatcgcatcattaacatgaactaccccctaaggcatgctgtcctcagagactgtaactactaacagatagcatggaagcaactccactattagacgtcattttttctagctagaacgtattattttcacaagtcaccttgaggaacaaactgcattttaaaaacctttctacttcatagaaaacaatttcacgtttttcaaaggacattcatattccacacctcactttatcttccaaatgaaaccaaaaaaataacttcagagatattatcactaaaattaaacaaatagg

SEQ ID NO: 80121 - DNA, 727 bp, Homo sapiens
aagccccccacaccggctgtgcacttctcagtgaggactgaagtcacacttggggactccaaatttgattttctgccaaccctggctgctaatggcagcagcagatcatcctctggtaccaagacttggcagcaccaaaatgcccagtctcatgtgagactgttagaatggactccaaagcccccaggaacccagagagcttcctgcctccccgctcctgccactcctgctcctgcaaagggaaaccctgcccctggctatggctgtcttcacaaacacactcgctgcctctactggcatcttgctccactgtgaggaaatgtgtttccatggtgatgccggctctgtgtgctggtttcggggatagtgggctggttttgaatcaggattgtaaacttgccttgtacttccctcccttgcctgcctaccagccaaggacgtcagagttgactgcaaaggcacacttagttaattgggaggcagaggaaggaccacggatggattaaactgcctgcttcctctgttcactgttcactagggctgaagccaagctagcattgtctcctttggacataaaggccagtccattgtcgtggtttaaagaaggccactccacagggtctgaaggacatttactaacactggggggagcatgatttttcaacaggaaaatgggtctattgcagtggctcgagtctggctgcatactggagtcacctgggaacgt

SEQ ID NO: 80122 - DNA, 232 bp, Homo sapiens
gaagcccgatttgaaacatttggcaatttctgtgttggaaatacactcaccacagttgatttaaagctgtcaatgtaaagtcactgaagaaggagacaagatgtgcacaactagttcctatgtgtgagtatgagttggctccagcatactatcgaaaccccacgtgttcttggtagcctttcattcaacagtatttcaagaataacttttcctgtcaacaaatgttcctttg

SEQ ID NO: 80123 - DNA, 239 bp, Homo sapiens
aggcacctgccactgcgcccggctaattttttgtatttttagtagagacgaggtttcaccgtgtcagccaggatggtcttgatctcctgacctcgtgatccaccagcctcggcctcccaaagtgctgggattacaggcatgagccaccagcgcccggccagttacatctttttaaaacattttagccaggtgcagtggcttacagctataatctcaacattttgggagacacaaggcag

SEQ ID NO: 80124 - DNA, 304 bp, Homo sapiens
gctgcagcttctggcatttggttgtcctgataaaaaggaggcagcaaaaactagaagccttgcactgaggtttagatttataccacattttaatctaattaatgtggttccttttttaaagacagatctcagtctgtcacccaggctagatctagtgcagtggcgagatcttggcttactgtagccttgacctcccgggctcaagcagtcctcccacctcagcctcccaggtagctgtgaccataggcatgtgccaccatacccagctcattgttctgtgtttttggtaaagacagggtttcac

SEQ ID NO: 80125 - DNA, 355 bp, Homo sapiens
tgagtagcaagtgattctagtttgtcatacaaagaagtgatatcatatttgtgtgaaataagtgcaaattaaaagtggtttgatttaaataaaaatattaagccagtgtacaggtgctgtatagatatggcaataatagtgaaagaaaaccttgaatgactgaagtttgagtcatgctgctctcatgtctataacatgattctctatgttctctatgaaaattcagttcacacgcaatttttaggaaatacttctggcaaactccgtatggttgccttctgtcacctgggtctgctactgtacattcacactaatataatgcgttgatggattaaattaaagttctgggcctgga

SEQ ID NO: 80126 - DNA, 438 bp, Homo sapiens
gtcatctctacttgccatcttgagcattcaccctaacgtcttcaagtttctattgcctcatctgaaaattgaggcctaacaatgtgtgtcttatacagctctggcaagagttaaattaggtgatacttgcaaaacatccagttcagttcctggtgcctaataggtttttaaaagtgatcactttaattgccagcaagtcttgttattttgagtcaaaatcaacctccttgtaacttccacttcagtagagttgccctcaaattacttgatttcctcttccacatgagaatatttctgccatttgaaaatagctctcataccctttctttgggatgattttatgctcttgttggtgcccggatcaattcttaagctgtcctccccatcctgcccaccaaagctcaagcctcaacttttctcctagccaggtcctctttt

SEQ ID NO: 80127 - DNA, 512 bp, Homo sapiens
acctaacagagcactgggcaacctaacagagcactcactgggcactgtagaaggcactcaataatcatttgttgaatgaaaggctaattttaccactttgggactttgagtttattatcctgctatagataaggatccctagggtgatcatgtaacttactgtccaaatgagatccttttgaaagtgaaagggaacactcaaataattttactgggacaacagttgtaacccagagctgttttggcaaactggggtatatgatcaccctaagaatagctctaatcaatgaagcttccatggctgaatagcccggctaccaggtaaataacaatggggaagtgtagcgcatagtgtgctttgcggagtaggcactcaacaattattggtggaacatgaatctaactgtatcatattctctttgaagcccatgggctctacattgtgaccctggggcataggcattccttgggatgactctgtccacagcagtcctgacgtgtgtgcttttgct

SEQ ID NO: 80128 - DNA, 215 bp, Homo sapiens
  misc_feature (164)..(164): n is a, c, g, or t
  misc_feature (169)..(169): n is a, c, g, or t
  misc_feature (189)..(189): n is a, c, g, or t
atgttacttttattgtaagaaaaccttcccttctccccttcttttttcctctccactaagagtctcctcttcttttcttctcttctgttgcctaggttggagtgctgtggtgtgatcacagctcactgcagcctcgacctctctggctcaggagaattgcttgnacccnggaggcggaggttgcagtgnaccaagattgcgccattgcaccccag

SEQ ID NO: 80129 - DNA, 719 bp, Homo sapiens
atcacctgctgtttcttgggacctgaccatgtacatactaatatgaagcactagggacttggtaggaaaaaagttcaggcattaacagcttgcttgtttcagccctcagcaaatatctagaaaaaagaaacagccttatcctgaaactggtcagtctgtaaacaaagaagggagaaatatggctttgctaagagaccccctttctaaacttaaggaatttcttcacatttaatttccatttaaatttcttcaggtaaaatttaaattaatgattttattaagaattatggccaggaggccgggctggtctcgagctcctgacctcgtgatctgcccaccttggcctcccaagcccatccatctttatcctgtcctctcaattcttggaagtacaatgcatagaacttttattctcagccatttgagagtaaattgcctgaggctccattaccctccaaacaaggacattctcctacataaccacaatggcaccatcaaaatcaggaaactggagtgataccatcaaaatgataccataaccatgaaaaccaggaactggaatgaaactgccaatccttagggccccttcacgttttgacaatcgttctaataatgtccttttcgcaaaaggagccagtttagagtcgcctgctgtattcagctgtcctgtctctctagtctctttcagtctagaacagtctcagtctgtccttgacttc

SEQ ID NO: 80130 - DNA, 443 bp, Homo sapiens
ggaatttccacagacaggaatttccacagagctagaactgttctctttatgggttcttgtctgcctcagatggcatccattacagtggggaatgtgttcatagttaaaaagttttgctatctccatgctcctagttcctataaaatcacttgcctcattgtgaatgttcctcatctccaccccaccttctccatccctaccccacagtctctgccctaccatcatctggctgactcctgtacattccattcttgccagctttgtaacctgccctttcctgttcagggcactttcctgatcatggcacactgcctacgctctgtccctcttctcaggctttcccactgaatgtgagttgcttgaccattttgattttgactattttattcaccactccatcccaagaacctaagcgcataataggtgaccaacaaatatttgct

SEQ ID NO: 80131 - DNA, 884 bp, Homo sapiens
gagacaaaggaaggcctcactaagaagtggaaaattaaggaagtcaggaatacaccaaacattcatatggaagaaagaaaggagttctaggaagatggagagaagcccagaagacagaggcaggttggtatgtcaaagaaacaacaattagacaagtgtagcaaaaggagagtagcttggggcagataatgggagataagtcagagtggtactagaacaaagggtttgctttaccctgagtttgatggaaagccatcatgcagtttgagcagagatgacatgatctaccttgtctttcaacaggaccaccctggctgcgatgtggtaactaaagacagcaaatactgaagcaggaaagagaaggtccttctaacaggagagacataatggctgactggaccgggggagggatagtaagagtgacagtaacaagccgttaagagtctggatatagtttgaagaaagagcccacaggatctgtgctaacagaaatgaaggacaatgacaagatttttgtctaagcaactgaaaaatggaggtactggtttgctaacatgagtaaaaacaacgtatgaggaagaaatatcaggggcccagttctgggtaggttaactttgttattagacatctgagtggagatattgagttaaggaacctggaattcagacgagaggtcagggctgaagatataaattcaggagtcatcataaattcaggagtcatcatcagatatagataattcttaaaggaatgaaaaagaatgagactacccagggactaagtgaagctagagaagcagggagcccaaggactgaatctgggatacttccaacacgaggagaaagagaactggcaagggtgactggaaagaggccagggaagaa

SEQ ID NO: 80132 - DNA, 637 bp, Homo sapiens
gtggcccctgaactccccctcgggctccctctgctcgccggacctctctgggatgtgaccaccctggctgcgatgtggtaactaaagacagcaaatactgaagcaggaaagagaaggtccttctaacaggagagacataatggctgactggaccgggggagggatagtaagagtgacagtaacaagccgttaagagtctggatatagtttgaagaaagagcccacaggatctgtgctaacagaaatgaaggacaatgacaagatttttgtctaagcaactgaaaaatggaggtactggtttgctaacatgagtaaaaacaacgtatgaggaagaaatatcaggggcccagttctgggtaggttaactttgttattagacatctgagtggagatattgagttaaggaacctggaattcagacgagaggtcagggctgaagatataaattcaggagtcatcataaattcaggagtcatcatcagatatagataattcttaaaggaatgaaaaagaatgagactacccagggactaagtgaagctagagaagcagggagcccaaggactgaatctgggatacttccaacacgaggagaaagagaactggcaagggtgactggaaagaggccagggaagaa

SEQ ID NO: 80133 - DNA, 2560 bp, Homo sapiens
ccagacaaacaaaagctgagggatttcatcaacactagactggtcccataagaaacgcttaagggagtactttggtcagaaagaaacagacattaatgagcaacaaagaatcatctaaaggtaaaaaactcactgttaagagtaagtacacagaaaaacccaaagtgtgataacattgtaactgtggtgtgtaagtagaaagaataaatgataaaccaatcaaaaatagtaactacaacttttcaagaccagtcagaaaaataagataaaattagaaacaacaaaaagttaaaaagtggggggatgaagttaagatgtagagtttttattagttttttgtttgttaatgcaaacagtgttaccaggttaaaataatgggttacaaaatagtatttgtaatccttatggtaacctcaaaccctaaaaacatacactggatacataaaaaataaaaagcaaaaacctaaactcatatcaccagagcaaactaccttccctaaaggaagacaggaagaaaagaaagaagaagaccacaaaacaaccagaaaacaaataaataacaaggcaggagtaagtctttacttatcgataatacattgaatggaaatatggactaaactctccaatcaaaagacatagactggctgaatgaatggagaaaacaagacccattgatctgttgcctacaagaaacacacttaaactataaagacacacataggctgaaagtaaagagttggaaagagttattccatgccaatggaaaccaggaaaaagagaaggagtattgattttgatacaaaaactatgagacaaataaagtcactatacaatgataaaggggttaatatggtttccatttgtgccccacccaaatttcgtgttctattgtaatcctcaatgttggaggtggggcctggtgggacgtgattagatcatgggggtggatctttcatgactaattcagcaccatcttcttagtgctgttctcatgatagtgagttcttctgaaatctggttgcttaaaagtgtgtagcacctctccacaccacccgcttgccttggtctactcctgctatgtagatgcttgctcccactttgcattattccatgagtaaaagctccctcaggccttcccagaatcagatgccgctatgcttcctgaacagcctgtggaactatgagccaattcaacctcttttcttcataaattaacaagtcttgggtatttctttatagcagtgtgagaacagaataatacagaaaattggtaaagaggagtgaggcattgctagaaagatacctgaaaatgtggaaacagcagtggaactgggaaatagacagaggttggaagagtgtggagggctccgaagataggaagatgaggggaagtttggaatttcttagagatttgttaaattgttttgaccaaaatactgatagtgatatggacaatgaagtccaggctgaggaggtctcagatggagatgagggacttattgggacctggagtgaaggtcacttttgttaggacattgtggttggagacattgtgcccctgccctaggaatctgtggaactttgaacttgagagcgaagatttagggtatctggcagaagaaatttctaagcagcaaagcgttcaagacgtggcctggctgcttctggtagtctgtgctcatatttgtgagcaaagacatgacaagaaactggaacttatatttaaaaaggaagcagagtgtaaaagtttggagaatttgcagcctggccatgttgtagaaaagaaaaaaaccattttctggagaggaattcaagctagctgcagaaaattgcaagtaacaaggagcaaaatgttgatagccaagatagtgggaaaaacaccttgaaggcatttcagataccttgggggcagcctctcccatcacaggcccaaaggcctaggagggaaggatggtttcctgggccaggctcagggtcctgctgccctgcacaacctcaggaaactgctctccaaatcccagctgctccagctccagcttcagctcaaagggccccaggtatagctcaggctgctgctccataggatgcaagttataagccttagtggctcccgtgtggtgttaaattaagcctgtaggtgcacagagtgcaagaattgaggcttgggagcctccaactagatttcagagtatgtgtgggaaagcctggatgtccaggcagaagccagctgcagggacagagccctcatggagaacctctactagggtagtgtggaggggaaatttggggttggagttcccacacagcttcccctctggtgtactgcctagtggagctgtgagaagacagccactgtcctccagattccaggatgatagatctgccaatgacagcttgcactgtacaactggaaaagccacaggcagtcaatgccagcccgtgaaagcagtgacagtggcttaccctgcaaagtcccaggggctgagctgcccaaggccttgggagcccaccccttgcaccagtgtgccctggatgtgagatatggagtcaaaggagagta

SEQ ID NO: 80134 - DNA, 1362 bp, Homo sapiens
ccagacaaacaaaagctgagggatttcatcaacactagactggtcccataagaaacgcttaagggagtactttggtcagaaagaaacagacattaatgagcaacaaagaatcatctaaaggtaaaaaactcactgttaagagtaagtacacagaaaaacccaaagtgtgataacattgtaactgtggtgtgtaagtagaaagaataaatgataaaccaatcaaaaatagtaactacaacttttcaagaccagtcagaaaaataagataaaattagaaacaacaaaaagttaaaaagtggggggatgaagttaagatgtagagtttttattagttttttgtttgttaatgcaaacagtgttaccaggttaaaataatgggttacaaaatagtatttgtaatccttatggtaacctcaaaccctaaaaacatacactggatacataaaaaataaaaagcaaaaacctaaactcatatcaccagagcaaactaccttccctaaaggaagacaggaagaaaagaaagaagaagaccacaaaacaaccagaaaacaaataaataacaaggcaggagtaagtctttacttatcgataatacattgaatggaaatatggactaaactctccaatcaaaagacatagactggctgaatgaatggagaaaacaagacccattgatctgttgcctacaagaaacacacttaaactataaagacacacataggctgaaagtaaagagttggaaagagttattccatgccaatggaaaccaggaaaaagagaaggagtattgattttgatacaaaaactatgagacaaataaagtcactatacaatgataaaggggttaatatggtttccatttgtgccccacccaaatttcgtgttctattgtaatcctcaatgttggaggtggggcctggtgggacgtgattagatcatgggggtggatctttcatgactaattcagcaccatcttcttagtgctgttctcatgatagtgagttcttctgaaatctggttgcttaaaagtgtgtagcacctctccacaccacccgcttgccttggtctactcctgctatgtagatgcttgctcccactttgcattattccatgagtaaaagctccctcaggccttcccagaatcagatgccgctatgctctaacgacaaaggggagctccttactagttcaaacacgggtacagacaacagcggtctgtcacagacccaacatggcgcatggaccacaaaggccaccaacgcgattccatcgcaaccggaagccccaagaggggagggcagaagagaccctgtgaagggaacacagataaccggtaagaagctatatcacctccccgggccg

SEQ ID NO: 80135 - DNA, 255 bp, Homo sapiens
accactccaaatactaaaaataaaataaaataaagtatggggttcctagggaactgactttgccaggacatacttttcgttggggcggaatgcaccgaaaatcattggtaggaaaaataattttttttttgaggaaaaatttggaaacctttttcccaaagggcccgcaagatcctaaaaaaagcaagagaccgcgcagaaaccgaggatccccctcacaggcgacacccagcgcgacctccgctagggtcctga

SEQ ID NO: 80136 - DNA, 449 bp, Homo sapiens
cctgacccacttctatgaatctagaattacctaaaatgtgattagacaagctacatgctgcaaaactgcttttggaatttgttaacatgccgtaataagatgttaggttggtgcaataggaattgcagtttttgccattaaaagtaatgaacaattcctttagcactaacaataatttagcacctaaaagtcaagcatttagaagtctgaaattctgaggcagcagaaaataacagttactttccaggtaatgtgaaacacacacatatgcaagtatgttcacaggccatacatgcaaattttaatgctattacataaacacataggtaggcatatatttcatatgctacaacatttatatacatatataaaaacttaagacacaggcatgcacatttagttaacaagccaatacgatatttgagtgtttctgggtaatatatcagtgt

SEQ ID NO: 80137 - DNA, 849 bp, Homo sapiens
gtttttactacttacatcataactcctcttatggaccatcatcaatacctaatctggaaaatttcccctgctccttgtcatatattcaaaattaatagatattttttctcttaacactaataagtttttaattacttcctatcttatctgttatcacaatgaatcaaattagttaggtatgcttatgtatctggtttttcaacacctatttaagggaagaaacaataggccattcatctttatatttctgggaccagagacatagcacttttgtgtcctcaatatccccaaatatgactatcacagggaaggtgcccacaaaatgtttgctgaatgaatctagttaagtcctcaataaataccagctgagtgaatgaatggaacttcatagaactataatcatattgatgatctgcattacatttcaaattgtttaatacaatttaacattcatgatatgcactttttcaggtaaaatgtaacaccttgactattgtacattaggatgttcttgaaatgtgaaatctaaataaatatgtatacaaatttggtatctcttttcgtggcagctctccttggctgagatttctggatcccctgtgggatctactgaactcagtatcacacgtaacttagctttgtttgattcaacctgccacacagttcaccagcctggatcttgttgatgtagctcattatccataaatcactacctgcattgtctaatttaagatccagggtaactgcatacttgtgttttgttgttgtttctttttttggggggagaggaatttacatgaaagcagaacagagagtaccatgattatacactaaatagaataagagaac

SEQ ID NO: 80138 - DNA, 1021 bp, Homo sapiens
cccccaccccttcttttacctaggcaagagattaggggagtcttttttgattaaagagagtaggtccaaaataaagaccctgaaacactaaaatctggggatccccaacaaaagaactggctcagtacctagtgatccgacggagacacctctgttagacagctcctgcccacacacacagcttccagtcttgctcttctatatgaacaggcagttaacgatgatcataaggaccaacctgagcagcagaaccaaagggactgaggaaacagacagtgctggtacaagtatgcaagttttctgtaaacagattactttcaaacagttgggagccccagggagataatagaaggtatcctactcaacagcagtatatagaatgctgtagaagaggaatattgtaagaacaagaactatctcttgaaaactaaaaatatgataactgaaatataaatttaaataggattggaagctaaagctaggaaattaccctagaatgttttttgagaaatggaaaatacgaagaccaaaaaaataaaataaaactatgctgtgaaagagaaagattagcatttgagaaggcggaagttggtcctgctcagatgcggttttcagatgccttattctaaaaatagtgatagaaaacaaatttctacaaagcaaaattacaataaatttattaaactcttgcaacaaagctgttttcttatgtcttcctatgttttcctgctgtcattcaatgtgatgctgaagttcttcctccttaaaaatgtaatatttttccctttgcacaggtaatttagagttttaatttatttggtcatcatgatagctattcctgatagctgtcctgttacttagacataaaaatagtgagtaagcccaattacatatttgtagggttgttgaactcttaaaaagaaatcacttctttaatttttctactttttaaaatgggaacgcagaataataatgaaatttgttctaaaccaaaaacctacctggtttaccagttattgca

SEQ ID NO: 80139 - DNA, 456 bp, Homo sapiens
ttaggaaaatgcaaatgaaatcctcaatgagataccacgtatccactaagatggctgtaataaaaaaagatggacaataacaagtgttggttaggatatgtggaaagtagaactttctggcattgctggtgagagagaatttaatgatgcagcagctttgtcatttcttcaaaatgtttaatgttccaaaaaatgttaaaagtggaattaccatataacccagcaattccactggtaggtataaacccaagataagtgaaaacacattcacataaaaattttatgaatgttcatggcagcattattcataatagccaaaaagcagaacaaccaaaatgtccatcaactaaagaatggataattaaaattaatatatccatacaatggaatattatttggcaataaaaagtaatgaagtactgatacatgctgcaaggtgaatgccccttgaaaaca

SEQ ID NO: 80140 - DNA, 994 bp, Homo sapiens
ctggagcaggtccctggcctctcctgggagcgagtttgagtgcagtctcccgtcagacctcctgcaatggaatctgcatttctgtaagcttgctcagcaagattgagagcagggtttggcatttctagcgagagtcccaaaaggaaagagggactgtacctgaagataaaaataacaaagaaattcctgcacctaaatctatgcagtgaaactaaatcagagagaaactattaagcagccagattttaaaaagacatcactttccgaggagctgtccccttatcaacagaaatgggagcttgaagacagtcaaatgatatcttccgtgagttgaaagatgcactgccagcctagaattatacacccagggagaccatctttaaagaatgaaggtgaaatcaaggcattttcaggcaaacaaaaagcttactttggcaccagcagacctgcacaaaaggatatacctcaggcaggaggaaactgaccccagagggaagatctgagaataacggatactgtgcacctaaattaaagctgaataaacaagaataacgtggggtacaacattttagaatgtggctgcacagtacgaagaggaatgaagggagggaaactgctcaaaggcccccccgccatgctgccctggaagaggatcaagatgcacattcgcttctgagtgtatgaagtatgtttattgcgattcctagggtaaccgctaaaataacccatttagctggaatcccagaaggaaagaagaagaagaagaaaaaaaacaaagagggagataaaatgaagataaatttcccaaagtaaaagcaaagagatgaaagaccctgtactgaaagggcctatagcgtgctgaagacaagaaataaagaaaaatgtcatctagatcatgctatagtcaaaatgaagaccgaagaaaaaattctaatagcttccagggaggagcaaaagattttagtcaaggataaagaattagacatcagatttt

SEQ ID NO: 80141 - DNA, 415 bp, Homo sapiens
ctactaaaaatgaggaaagtaattattcatttataactggtagacacagtcttttaaaacggtgattttgagcctttttggtgttaaggtttttaaaacgtgattgcatagcggctaccaacatcataagttggttgtttttcatttcaatgcccttttgaaatctttaactatattgtgatgctcagaaataatatgcagaattttttatttgtgtcccaaaatggtatgtgagtggttatacactttacatacctttctgccactttctttggtgtattttgtattatgttttccagatgtatccacattgatatgattatctctggtttaattcattttatacttttcattgtattcccttataccactttaccacatttagttagactctcctgttgctgataaatgaaga

SEQ ID NO: 80142 - DNA, 2250 bp, Homo sapiens
ccctttaagacagaaagtccgttggaaccgtcggctgctctctggtctctggagatgaggcgggaggacttggggacagctgtggggacacggcccagatgctctggtcccagcagaagtgactggcggggaccaggatgctggagggtcagctcgaggccggggagcccaaggagggcacccacccagaagacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggcattggaacctgcttttggaaaaatttcacctctgtcagctgatgaagagacaacacccaaatacgctggccgcaagagtcagagtgccactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacgggaggtgtctgaagacggaaagattatgcatccatcttcccgaagtccgcaaaactccggtggcagaaaatcaccagtgcaggcttcccaggccaccacgctgcaggagcagacggcagcagccagaggagctgacagaagctcatcagtcttagggagttctgaaggcggatttctcagccgcgttcaagctgacgagttcgccagttcttccccagacagtgcagagcggcaggaaaaattctaccccaatggctccaaagaaatcgtgtttcccgacgggacggtggaacatctcaaggatggacaggaagagaccttatttcctgatgggacaatcgtaagggtggaaaggaacggcgacaaaaccattgtgctcagcaacgggcagaaagaaatccacacagcccggttcaagaggagggagtacccggatggcaccgtcaagactgtgtattgcagcggctgtcaggaaaccaagtatgcctccgggagggttaagatcaaagatgaagctggaaatgtcgtcctggacgagaagcagatgagccctcaacacgcagcatcacatgggaaatgccaattgcagatttttgctaaaacagacaaaaactaataacatattagctgccctaaatgatcttggagagccaccaaaactttaggactacccaagtcatctagaaattgcaaaggaaaagacattctctcccctatttaggaaacttggttagagcagcacacgtcggagaacaggaggctcacaaaagaacgattttcagtgcccccagcaaggctgcaccctccttgatcatcacaggggccatttctgccttgtgatggacccaggaggtctctgcagagcaagtgccgttggaccagctgattcacaaagtgctgagcccctcttccccgtgtggcccaccccaggcacggctcattcctccagaattatagaagctcagcctggcctgctcccctctggtcaccgacacccctgtcctcgctgggacaagagggagacaattctagtcactacaaggacacccaaggggtctgagtcagggctccaatagtgcagttatcgtggcctctcgcagcccggggagcacgtcgcctcttgaaactcgagatttcttaaatccaatataaaatgataaccagttacttacttctttgttgtttgcaggccacctagaaatacaaatgccaattcacctaatttttatactgaaatgtagatgcccccaacatgattttggaaagatataatttcttgaaaatcttatcagaagatgcatagttaatttttttccattatgtactcatgtttttatgaaatacaataccatattttagggccagggattattttaaccttaaaattttgcatgcgtcattgtagccctcaatatttggtaatgctatttaaagtgactcaagaagcatgtgctatctggctttgaaggaaaaaaaaa

SEQ ID NO: 80143 - DNA, 1051 bp, Homo sapiens
ccctttaagacagaaagtccgttggaaccgtcggctgctctctggtctctggagatgaggcgggaggacttggggacagctgtggggacacggcccagatgctctggtcccagcagaagtgactggcggggaccaggtgaggtgatgaggtctgttagtggggctgagggaaggggtcttccccagactgagggggtcacaagtttggggccgaggacactggggtatcccctcggaggagcgggaaagaagaagctttctcagggctgtgaggaccgcggacccttgcccacttccacagaaactgtcccaatccccgcggggaaggaacagccagggatccggttactggcattggaacctgcttttggaaaaatttcacctctgtcagctgatgaagagacaacacccaaatacgctggccgcaagagtcagagtgccactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacgggaggtgtctgaagacggaaaggtgacctcggaaacctgggtcactctacactggcagcatggaaaattcagattcagatgaagttccacttaggtctcataagagtactcaatttgttattcgaaatagacctagtaatttattaacctaattatgtttctatagataaaactttgaatttctgcagacatgtctttaatgctataaaagcaaataaattgaattgggttttaaaaagcaaacaacttgaattgggttttaaaaatcaattactttcccgagctccgtaattggtatatttctgcagagtctttaaaagaattgatctaccttgtagtgctgagctcagggctgttgggtgagccctggggtcttgctggaaattgtggatggctgaagatggcttcgtgctcccagcctttgg

SEQ ID NO: 80144 - DNA, 740 bp, Homo sapiens
  misc_feature (153)..(153): n is a, c, g, or t
tcgtattgcaacaacgttgctcctgcctgggtcttcagctccacaaaaatcaatctagaacaagacctctcctccctaagtctccagcttccggatcctcgaattgcaacaaccttgctcctgcctgggtcttcagctccacaaaaatcaatntagaacaagacctctcctccctgggtcgccagcttcctgaccctcgaactacaacaaaattgctcctccctgggtcggcagctccacgaccctcagaccacaacaagacctctcctgcatcgccagctttctgaccctcgaactacagcaacgttcctcctgcctgggtctgcagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggtaccaaaggcgcatttgtgtttttgtatcatttgcgtcgtgtaaatatagcgtccccgtaaagatgtgggctttgttgctgggtgacgtggtatctctcacgttccaggtggtgggagggcttgctatctttccatcagctccatttcccacaagtaaagattaaagaactggatacatcaggcatctcacctgacactccagcagacagaagcacag

SEQ ID NO: 80145 - DNA, 1412 bp, Homo sapiens
ccctttaagacagaaagtccgttggaaccgtcggctgctctctggtctctggagatgaggcgggaggacttggggacagctgtggggacacggcccagatgctctggtcccagcagaagtgactggcggggaccaggtgaggtgatgaggtctgttagtggggctgagggaaggggtcttccccagactgagggggtcacaagtttggggccgaggacactggggtatcccctcggaggagcgggaaagaagaagctttctcagggctgtgaggaccgcggacccttgcccacttccacagaaactgtcccaatccccgcggggaaggaacagccagggatccggttactggatgctggagggtcagctcgaggccggggagcccaaggagggcacccacccagaagacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggcattggaacctgcttttggaaaaatttcacctctgtcagctgatgaagagacaacacccaaatacgctggccgcaagagtcagagtgccactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacgggaggtgtctgaagacggaaaggtgacctcggaaacctgggtcactctacactggcagcatggaaaattcagattcagatgaagttccacttaggtctcataagagtactcaatttgttattcgaaatagacctagtaatttattaacctaattatgtttctatagataaaactttgaatttctgcagacatgtctttaatgctataaaagcaaataaattgaattgggttttaaaaagcaaacaacttgaattgggttttaaaaatcaattactttcccgagctccgtaattggtatatttctgcagagtctttaaaagaattgatctaccttgtagtgctgagctcagggctgttgggtgagccctggggtcttgctggaaattgtggatggctgaagatggcttcgtgctcccagcctttgg

SEQ ID NO: 80146 - DNA, 413 bp, Homo sapiens
gtaggtggctgagtggcttctgtgagggcggcccacccggttcccctcagggagacctgagaaggtgaccttttcgtcctggggaagtgagattcggagccggtgtcatgagatggttgcatcttcccatcttctcaacaagaacagaaaattaagatgattccaaatgtctctttatttcctgaagttcagcctttcaaacagagacttttttttatagatttaagttggttgcatttagcacaaacaagattaatgttttttatgacttaagagttcccctagtcagagtttcattttttatcattttgatttacagttctcagttgacattaatagactcgaaggcaagaatagcaaacatacttctaagccctagctaggggccgacttgtaacatgctatattttaca

SEQ ID NO: 80147 - DNA, 252 bp, Homo sapiens
atgaaagaattaatgttcttacaggatcacttgttgttgaactgacctgacatgtgtatagtgatctcatgaacaagagggaagctgtgcatccattcacttcaattggatttagcaatcgcagtaggataatgatatttccacaatgtatatgctctgtccctttaaatttaactttttgctttttagacagaagctcatcagtcttagggagttctgaaggcggatttctcagccgcgttcaagctgacg

SEQ ID NO: 80148 - DNA, 731 bp, Homo sapiens
ccctttaagacagaaagtccgttggaaccgtcggctgctctctggtctctggagatgaggcgggaggacttggggacagctgtggggacacggcccagatgctctggtcccagcagaagtgactggcggggaccaggatgctggagggtcagctcgaggccggggagcccaaggagggcacccacccagaagacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggcattggaacctgcttttggaaaaatttcacctctgtcagctgatgaagagacaacacccaaatacgctggccgcaagagtcagagtgccactctcctgggacaaagatggtcatctaaccacttagctcctccaaaggtgacccttcgtgcttatcgtctgtaaagagcagcagagcttctgtacccaaacacacacatcccatcagctcctcaccacacagtttcacctccc

SEQ ID NO: 80149 - DNA, 931 bp, Homo sapiens
ccctttaagacagaaagtccgttggaaccgtcggctgctctctggtctctggagatgaggcgggaggacttggggacagctgtggggacacggcccagatgctctggtcccagcagaagtgactggcggggaccaggtgaggtgatgaggtctgttagtggggctgagggaaggggtcttccccagactgagggggtcacaagtttggggccgaggacactggggtatcccctcggaggagcgggaaagaagaagctttctcagggctgtgaggaccgcggacccttgcccacttccacagaaactgtcccaatccccgcggggaaggaacagccagggatccggttactggatgctggagggtcagctcgaggccggggagcccaaggagggcacccacccagaagacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggtaccaaaggcgcatttgtgtttttgtatcatttgcgtcgtgtaaatatagcgtccccgtaaagatgtgggctttgttgctgggtgacgtggtatctctcacgttccaggtggtgggagggcttgctatctttccatcagctccatttcccacaagtaaagattaaagaactggatacatcaggcatctcacctgacactccagcagacagaagcacag

SEQ ID NO: 80150 - DNA, 430 bp, Homo sapiens
tactttttgctatttgctaattgtgttcctctccattcataataataacaacaaaataaaatgataatgataatagctagtttttatatgttgggcattgttctaaacactttacatatgttagctcttatttaatcctcataaaaaccctgttagatagtactattattatggtcattttacaggtgagaaactgagttatagagaagtttagtgattttcaaagaacacaagaaggttagcagtggagccagaatctgaacctgagctctctgtctccaaagtccttgctcttttttttttttttcctttttgcaaaactccatgacttttaattttcacttttgaactaatcagaatgttattggcaaaatggccatattatgtgtatgcataatatttctttttaaaagatttcttctaaaaaaaa

SEQ ID NO: 80151 - DNA, 326 bp, Homo sapiens
ccaccttcagctctggttggacagaagccaccccgtccaggctcccaccttgtaggagagccgaggggtctggtagggagcggaggccgaggtctcggccaccgggagaatgacgagcccactggagaaggaccctgagcccaatggggcactgagccctgggcctggggataccaatagctggggctttgggagggatccagcccccagtcctcgagactcactggccccggaagacttagagatgtttgtgctggactttgaggatggtgacctgtgggagtccatcaggggccagctgggccccatggcagggccaccaactt

SEQ ID NO: 80152 - DNA, 555 bp, Homo sapiens
gaacccactagcagaatcagaggaatggccatctttgaaaatcacagtagaaaataagagcaaacaaaactaagtctgcagagcaaatgacaaaactgaaaagaaacagcatgcacacatgaaaagaaaggcataaaaacatggcagcagtgagactaaccatgataagtttagttattaaatgtagattccctattaatagaaaaagcctcccagattgtgttaaaaattaaaatccaatactttactgcttataaaaaaatacttctaaataaaataagacaaaaagactacaaagaaaaggataggtaaatatgtagtaagcaagcttgtaataaattaggaaaaagcattattacattaaaatagaattcaaagcttaaaggttattttgatttaatataaacatgagatacacaaaaagataaatgtcaatagatacaacaattcacaaaattgaaaataaattagctaactatgggagtgttgcagaaccactacctcactgtatcagttttcctcttcttcctgggcacatgggtaaagtataccttc

SEQ ID NO: 80153 - DNA, 950 bp, Homo sapiens
tcctaattgtacttaagtaaggaaatagctcatttatgaatctaagaagattaaagaatatggctttagtgtgtttgtttagaatctatgccaaaatttttttccgaagcataaatctggttttttttcttttccttaaaaaaaactttaataaagccaaagaaagaaagaaaggaaagaaagaaagaaagagggctccacatgcagtttcagcactaagggatcctgacaagtaattcacctctgctttgaatgtgggatttttgcactctatgatatatacctttggagtggttttgttttctttgtggttttttttttgtttgttttttgttttttgttttttttgtgtgagacagtggatttttttatccatcattgcattattggagttttatgtgatttaatgtataaaaagtgaggctattctccaactagttgtttgggtttctgtaaagttcaatttccacagtttacctcaagaggtcttttaaaaatgaaatttcaagcatgttgcttgatattctttaacatgttctcaattaatttgcaataaagtccagcccccttcctattgcacactattgtacccttcctgcctttttcatgcactgctctccacccaccctggcttcccggctttgcctccaacgtcagagtgatttctgggcttgcttttttttttttttttttgcctggaaacttcttctctgaagaactttcaaatggctgccttcttcatgtatctcctctcggagcatcattccctgaccttcctttctagggctctgaatccaccccattgctgtctatccagtcagtctctcttttctagctggcatccatcacaagcaatctgcttatcttgtttttggtgagtttatatctgtttctaccactggattataaatacttccaggatagagatctagtttatatcactcaccatt

SEQ ID NO: 80154 - DNA, 365 bp, Homo sapiens
aaacagtgtattgtttagttctcccaacatctagcactatgcctggcaaataatgaggatttcacatacacatttttaacagctctgtatagatatagttgacagataataagctgcacaatttgatttgttttcaatgtatgtataaacccatgaatccatcacataatcaagatgttgatcctggctaacacggtgaaaccccgtctctactaaaaatacaaaaaattagccgggcctacgtagtggcgggcgcctgtagtcccagctactcgggaggctgaggcaggagaacggcgtgaacccaggaggcggagcttgcagtgagctgagatggcgccactgcactccagcctgggcgacaa

SEQ ID NO: 80155 - DNA, 265 bp, Homo sapiens
gctcgacgtgagataaacattggatgggaccatcaggaaactagacatcacagaagaagatattaataaagctatagttctatcactatagctttattaatatcttcttctgtgatgtctagtttcctgatggtcccatccaatgtttatctcacacattatagttttcatccttataagttagatttctgccttttttgtgtttttcgtgtctctactttgatcatatgcaatacagttataactgtttcattatctttctctg

SEQ ID NO: 80156 - DNA, 170 bp, Homo sapiens
aaaaaaagaaaaaaaagaaaaagaaaagatgcatccttcctatgacaaattgtgcaagaaggtaacaagcactgttcaaactgctcttcattaacgtttcatgaagaaaacactttaattttttggattacagtgtactaaaatattttactgttcttttcgttttccta

SEQ ID NO: 80157 - DNA, 437 bp, Homo sapiens
atgggaaacctggtatctcttaaaagttggtccttattctgtagttacttttaaaaagtatattaagaatattcaataaaaatgtgttatgctgaaacaaaaagacacatgaaactgcttgaaaacttcattgatatggttaggctttatgtctccacccacatctcatcttgaattataattcgcaggtgttgagggaaagacctggtgggaggtgattggatcatgggggcagtttcccccatgctgttctcatgatagtgagttctcacgagatctgatggttttataagcatctggtatttcccttgcttgcacttctctctcttgctgccatgtaaagaaggtccttgcttcccctttgccttccatcatgactaagtttcctgaggcctccccagccatgcagaactgtgagtgaattaaacctcttttct

SEQ ID NO: 80158 - DNA, 429 bp, Homo sapiens
ctctaagtcattttgacctgagccattttactccagcaagaggtataattaaacaggattcagtggacatggaatcaatgtctctgcatgctttccagaggacagcacacttaaaataggctcttagaaattgtctgcctctttaaaggatatgaggcccctagaaattgtctgcctctttaaaggacagggtaggagttgtttccctcaccttacatttgtggattaaaatgttttaaataaaagaatgaaattgactaatgaaatgaaatgtctaaagactattatgtgccttagaggttggtaccatgtaaaaatataaaaagaatgttcttttgagtaataattattatgtggacatagtaacattgggaagcaaggttaataactgaccggttgaagagtttgtgtcaatctgatttagactgc

SEQ ID NO: 80159 - DNA, 404 bp, Homo sapiens
gtgacaaatgttaagaaattgtgtgtcaagcaaaatactttagaggccaatgggccacatgtttttgatatcaagagattacacacaaaatttgttttctagcttcttttgaaaaatcagaattgggaagatgtattcatgagtgactgctgccccctttggttgggactcgttccttcaggttcattacatggtcatcaataaccatttccttggtccctgcttttgtcttgtctggactctaagcatttgaatttttagtattataagaaaacttaatactttactatcagtcaccacatacatgtgtttctatctgtactacgacttattaaaagccttttatcaatagcctccattttggagggggggatttcaactggtgcctagactagcaaggattt

SEQ ID NO: 80160 - DNA, 511 bp, Homo sapiens
acagaaagcacttaactggtttcccatatatgggtgggctgagaggagcgtgaaagagggattacaaagaggtatgaggaaactctggggataatggatatgttcttgactgtggtggtggtttcatgggtatatacatgtcaaagtttatcatgttatacactttaaatatacgcagtttactgtatttcaattatacctacaaaatatcttttaaaaagacaacaaagtaatattaccttttcctttcaggtctaaaacaaacactatattccctttccttttttttttttttttttaaattggcaagcaaaaaccgcatatatttatggtgtataacatgatgttttcatatatgtctgcagtgtagaatggcaaaatcaacctacttaatgtatgcattacctcacaatacttatcattttttgtaatgagactaattaaaatcttctcttggaaatgttcacgtataggctgggggcgatggctcatgcctgtaatcccagcactt

SEQ ID NO: 80161 - DNA, 372 bp, Homo sapiens
agcactgaagcataataaatatgattcaagaggtataaaataaacaacactattatatgtgtaactgtaggtatgatctgtcccgctcatttacaaagattccatactatgtcctagtgactcttatctaggtggaatgtcattatatttgatttctcctatgataagttcactttcagaaaaacatgtcttgagcaatcactttatagcataagctctttccctattgccgggaggtaatagtgagcatcactaagggtagttggatataatgggagtagtcaccgaagaactgcaaaggctgaaattagggaaaggaaatattaagactgtttattcccatggggaaaactctccaactctttgaaaaaa

SEQ ID NO: 80162 - DNA, 321 bp, Homo sapiens
atagaaagacctcaaaaacatttacaaggaaagtaaaacaattaagtaaattagggactttttctaaatattctcttctgagctaaagcatgactttaaaccattattaaccttatgtcatttttatacattagagctttcactcaaagcacatgccaagtatgtgtgctgacatgtattaattcaaattttaagtaagtttgcttacatttacacaggtgtctatttttggtcaaatgaaattcaaaattgaactagcaggttgcaaaatatatgtgtttagaggtgaggtcctatatgaagacaacggttgcttaaact

SEQ ID NO: 80163 - DNA, 252 bp, Homo sapiens
taatactaaagtcaggtcagaaaacaacaagaaaataaaatacaagccaatatccttgatgaacatagatgcaggaattctcaggaaaatactagcaaaccaaattcatcaggacattaaaaggctcattcaccatgattaagtggaatttgtccctagggtgcagacttttaaatataaataaattaataaatgtaatataccacattcacagaataaaggacaaaaaccatgtgatcatctcaatagatt

SEQ ID NO: 80164 - DNA, 275 bp, Homo sapiens
ccattctgcaaaacacatccagtaagcatctcactactgaagtatctgacaaactacctttatgggccgtctgcagcctagcacaagtggcaggctggcaatttttttttctccaaaataataacaaaaagcttctacctcttccattattgtaagctgactcacctcccaatggaacactatacagactcccctgtcctatattgtggaccaattcagtattagaaaaaaaccacttccaattttctttagagtgtttttaagaacttggtcac

SEQ ID NO: 80165 - DNA, 679 bp, Homo sapiens
ggcctgacgtagctgatcggcccggaagtgctcacacgtgtgctccctgccctgctcctggccccttggctggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggtctgcaccgctgtctggcctgcgcgaggtacttcatcgattccaccaacctgaagacccacttccgatccaaagaccacaagaaaaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgccccaaataaaggaactggacaaagagaacaaaccaccaaaaactctccaagcgct

SEQ ID NO: 80166 - DNA, 631 bp, Homo sapiens
ggcctgacgtagctgatcggcccggaagtgctcacacgtgtgctccctgccctgctcctggccccttggctggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggtctgcaccgctgtctggcctgcgcgaggtacttcatcgattccaccaacctgaagacccacttccgatccaaagaccacaagaaaagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgccccaaataaaggaactggacaaagagaacaaaccaccaaaaactctccaagcgct

SEQ ID NO: 80167 - DNA, 648 bp, Homo sapiens
ggcctgacgtagctgatcggcccggaagtgctcacacgtgtgctccctgccctgctcctggccccttggctggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggtctgcaccgctgtctggcctgcgcgaggtacttcatcgattccaccaacctgaagacccacttccgatccaaagaccacaagaaaaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgccccaaataaaggaactggacaaag

SEQ ID NO: 80168 - DNA, 2028 bp, Homo sapiens
attaacctccagctttttaagcagtttatcgatggtcgactggcaaaactaaatgcaggaaggggtttctctgatgtatttgaagaagagatcacttcaggtggcttttgtggagggaacccgaggtcatatcaacaatgggtgcatacagtcaagaaaggaggtgcactgttcaacacagcaatgaccaaagcaacccctgctgtacggacagcatataaatttgcaaaaaatcatgcaaagctgggactaaaggaagtgaagagtaaactaaaacacaaggaaaatgaagaagattatgggacctgttctagttctgtacaatatacaccagtttacaaattacacaatgaaaagggaggaaactcagaaaagcgtaagcttgctcaggcacgcttaaaaaggcctcttaagagccttgatggtgctctatatgatgatgaagatgatgatgacattgaaagagcaagcaagttatcttctgaagatggtgaagaagcttctgcttatctctatgagagtgatgactctgttgaaacaagagtgaagactccttactcaggtgaaatggacttactaggagagattcttgatacattgagcacacacagctcagatcaggggaagctggcagctgcaaagagcttggatttctttagatcaatggatgacattgattacaaacctacgaataaatctaatgctcctagtgagaataacctggctttcctctgtggtggttctggtgaccaagcagagtggaatcttgggcaagacgatagtgccctccatggcaaacacctccctccatctcctaggaagcgggtttcctctagtggtttgacagattctctgtttatcctgaaagaggaaaacagtaacaagcacctcggtgctgacaatgtgagtgaccctacttcaggactggatttccaactcacttcccctgaagtttcccagactgataaaggaaaaacagaaaagagggaaacactaagccagatttcagatgatctgcttatacccggtcttgggcggcattcatcgacttttgttccttgggagaaagaagggaaagaagccaaagagacttcagaagatattggactgctccatgaagtagtgtcattatgtcatatgacatctgacttccaacaaagcttgaacatttcagacaaaaacacaaatggaaaccaaacttaaatcttgcatccaagcttctatggagacattttgagattcaatgcaatctgtataataaacagaattatttgtaggaatggcaactcatactatttaaatttttttttgcatttgcaacatttttctcacttgttcatttcgaggatatatgaaatgcattgatttttaaatataaagcgaattctactgtgcttttaaatcaggtactagtttgtatgtatgtttaaagtatgtattgaccatgagatttcccagtgtttggtgcttaatgccgtttattttatttaagctaagaatgcatatgtaacccatgcacataaccagtagctactatactaatctggttgagcatgaactgatcaagatatcaaaacttatcaaaactagcctgaagctgatgaaactgttaacccactaattgccttaatcttaaagctgttttttaagcatacttaaataatgtatgaaagtatgtataaagtttgaaggataagttattagtgttctgcagagcaataatgcctttttctattcatcaaatcaaggtcaaaattcatcttttcaagattaaaaagctctcttaatggaaatatttaatttgcttatataaagcactatagccatgttttccaaaaagtataaaaatatacacttacctttcattcagtgaaatataggaagtgctgaattacaatgtgaagttaatgacttctgtttacaaatgagacactctaacgagttttcagtctctctgtatgcctttgctatttaggggtccaccccaagaaagccaaatacaacataaaccgtcctgacaaaaaaaaa

SEQ ID NO: 80169 - DNA, 1877 bp, Homo sapiens
  misc_feature (1819)..(1819): n is a, c, g, or t
gcagtctacagctacgggtgatggagtagctagggcctttcttagagcacaggctgctttgtttggatcctacagagatgcactgagatacaaacctggtgagcccatcactttctgtgaggagagttttgtaaagcaccgctcaagcgtgatgaaacagttcctggaaactgccattaacctccagctttttaagcagtttatcgatggtcgactggcaaaactaaatgcaggaaggggtttctctgatgtatttgaagaagagatcacttcaggtggcttttgtggagggaacccgaggtcatatcaacaatgggtgcatacagtcaagaaaggaggtgcactgttcaacacagcaatgaccaaagcaacccctgctgtacggacagcatataaatttgcaaaaaatcatgcaaagctgggactaaaggaagtgaagagtaaactaaaacacaaggaaaatgaagaagattatgggacctgttctagttctgtacaatatacaccagtttacaaattacacaatgaaaagggaggaaactcagaaaagcgtaagcttgctcaggcacgcttaaaaaggcctcttaagagccttgatggtgctctatatgatgatgaagatgatgatgacattgaaagagcaagcaagttatcttctgaagatggtgaagaagcttctgcttatctctatgagagtgatgactctgttgaaacaagagtgaagactccttactcaggtgaaatggacttactaggagagattcttgatacattgagcacacacagctcagatcaggggaagctggcagctgcaaagagcttggatttctttagatcaatggatgacattgattacaaacctacgaataaatctaatgctcctagtgagaataacctggctttcctctgtggtggttctggtgaccaagcagagtggaatcttgggcaagacgatagtgccctccatggcaaacacctccctccatctcctaggaagcgggtttcctctagtggtttgacagattctctgtttatcctgaaagaggaaaacagtaacaagcacctcggtgctgacaatgtgagtgaccctacttcaggactggatttccaactcacttcccctgaagtttcccagactgataaaggaaaaacagaaaagagggaaacactaagccagatttcagatgatctgcttatacccggtcttgggcggcattcatcgacttttgttccttgggagaaagaagggaaagaagccaaagagacttcagaagatattggactgctccatgaagtagtgtcattatgtcatatgacatctgacttccaacaaagcttgaacatttcagacaaaaacacaaatggaaaccaaacttaaatcttgcatccaagcttctatggagacattttgagattcaatgcaatctgtataataaacagaattatttgtaggaatggcaactcatactatttaaatttttttttgcatttgcaacatttttctcacttgttcatttcgaggatatatgaaatgcattgatttttaaatataaagcgaattctactgtgcttttaaatcaggtactagtttgtatgtatgtttaaagtatgtattgaccatgagatttcccagtgtttggtgcttaatgccgtttattttatttaagctaagaatgcatatgtaacccatgcacataaccagtagctactatactaatctggttgagcatgaactgatcaagatatcaaaacttatcaaaactagcctgaagctgatgaaactgttaacccactaattgccttaatcttaagttagganttttaaaaaaggttaaaaagttgttaaaagtttaaagaataggttttatggtttttta

SEQ ID NO: 80170 - DNA, 469 bp, Homo sapiens
gcagtctacagctacgggtgatggagtagctagggcctttcttagagcacaggctgctttgtttggatcctacagagatgcactgagatacaaacctggtgagcccatcactttctgtgaggagagttttgtaaagcaccgctcaagcgtgatgaaacagttcctggaaactgccattaacctccagctttttaagcagtttatcgatggtcgactggcaaaactaaatgcaggaaggggtttctctgatgtatttgaagaagagatcacttcaggtggcttttgtggaggtaaagacaagttacaatatgattatccattttctcaataacaattttcttggtctttgcacttgtgtctgataaaacctatttcataaacaactaatgatttcctcctaaatatgtaatgtcttaaatacatttttcatcttataaaagctatggaattagcttattttgcctgatac

SEQ ID NO: 80171 - DNA, 755 bp, Homo sapiens
gcagtctacagctacgggtgatggagtagctagggcctttcttagagcacaggctgctttgtttggatcctacagagatgcactgagatacaaacctggtgagcccatcactttctgtgaggagagttttgtaaagcaccgctcaagcgtgatgaaacagttcctggaaactgccattaacctccagctttttaagcagtttatcgatggtcgactggcaaaactaaatgcaggaaggggtttctctgatgtatttgaagaagagatcacttcaggtggcttttgtggagggaacccgaggtcatatcaacaatgggtgcatacagtcaagaaaggaggtgcactgttcaacacagcaatgaccaaagcaacccctgctgtacggacagcatataaatttgtaagtttttttgatatttaacaatcctatttatgaaattataaaacattttcctaggtgatagacatataaattctgaatattttctatttttcttttaaataaacctaaaaaaaaattaggattaatattgaccaaagcaaattcaattgttaaaattataacattgcatgcagagggtagtttcttttatataatctaaaaatggttctcatttcattccaaagctatcggcaaagttgtgcagcaaattgaaacagttattgatggggtaccattttgtaaaatgtcattatttcatttaacaacattttacattcttgctgtgtacttgcggctcaagtagaaaaaaaaa

SEQ ID NO: 80172 - DNA, 295 bp, Homo sapiens
agaaacctgtgaatactgcaaactagcctctgacttcctcctactgagtctagttcatggtatccaggactctttatgctcataactctctctgattcccattgggtgatacctgacagccaaccagccgctctgccaccagaactcatttctccctgaaaaagaagaaaatcatatttggcagagcattctctggtctgccctgtaatgtgcttaaatgtcaggcaacatcctctttttttaaaaaaaaatggtatttttctttaaatttcaccctaataagaaagctattttc

SEQ ID NO: 80173 - DNA, 492 bp, Homo sapiens
  misc_feature (477)..(477): n is a, c, g, or t
ggaaacaactggaagaaatccaaaaagaaaatggccgatatattgaattactgaaagctaatgacatatgcttatatgatgacccgacaattcactggaaaggaaatcttaaaaactcaaaggtctctgttgttattcctagtgaccaggttcaaaaaaaattattgtttattccaacgggaatcagcctggtggaaacagccagggaacagctgttcaggggataacttttaatgttagtcataatttacaaaagcagaccgccaatgtggtgccagtacagaggacttgcaatcttgtgactcctgtatctatttctggagtttacccttctgaaaacaagccatggcatcagaccacagttcctgcattggctaccaaccaggctgttcctctttgtcttcctgctgccatttctgctcagagtattctcgagcttcccacctctgaaagcgaatcaaacaggaaataaatgtnaattgcccttgaaaa

SEQ ID NO: 80174 - DNA, 633 bp, Homo sapiens
ggaaacaactggaagaaatccaaaaagaaaatggccgatatattgaattactgaaagctaatgacatatgcttatatgatgacccgacaattcactggaaaggaaatcttaaaaactcaaaggtctctgttgttattcctagtgaccaggttcaaaaaaaattattgtttattccaacgggaatcagcctggtggaaacagccagggaacagctgttcaggggataacttttaatgttagtcataatttacaaaagcagaccgccaatgtggtgccagtacagaggacttgcaatcttgtgactcctgtatctatttctggagtttacccttctgaaaacaagccatggcatcagaccacagttcctgcattggctaccaaccaggctgttcctctttgtcttcctgctgccatttctgctcagagtattctcgagcttcccacctctgaaagcgaatcaaatgtgcttggtgccactagtggctcactgattgctgtttcaattgaatctgagcctcaccaacatcattctttgcacacatgcctaaatgatcaaaattcttctgaaaataagaatggacaagagaaccccaaagtattgaagaaaatgaccccttgtgttacaaacatccc

SEQ ID NO: 80175 - DNA, 362 bp, Homo sapiens
ctggtcagtcatagagaccactttgaagtgcctttattttgaacactaggaaagaactacaggagagccacagccctctgaagtagtaatttttgtaaatttgcgaataatgatgttacatcacgtcactgggacatcaaacctgtctaatgtgcactactactcccacactactactgctaaggcaacaaccatttactaggcttattggccgtgtgccaagtgctgtgtttatttcttattttcataggatatgttatttaattaacgggtagctaagagagagggttccagagacaaactgctaaggttcacattcttgcttccattatttgctagctgcatgaacttagccaaatttc

SEQ ID NO: 80176 - DNA, 331 bp, Homo sapiens
ttttagcagctaaagtaactgaggaacaaagatgtcaaaggtctactttatgttactacttcattagtgacagtcacaactagaactaaggactatgggttactaaattgtgtcttatatggatattttaatagaaaatttggatgttattactgatgctttatacatctatgcagatgttagatttttttgatgcaattacacttgacccttgaacaaaatgggggaagggacactgtcaccaccacagctgaaaatctatgtgtaacttttgacaactccaaaatttaactactaataacctactattcactggaagcctcaccaataa

SEQ ID NO: 80177 - DNA, 1318 bp, Homo sapiens
acttcctccggcctcccgctctcacttccttctcgagcccggagccgctgccgccgcccccagctcccccgcctcggggagggcaccaggtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttccctgaatgcctttttctctgagtgcctttttctccttaaggaggcctgcagagaaaggggctttgggctctgcccccctctgcttgggaacactgggtattctcatgagctcatccaagccaaggttggacccctccccaagaggccaacccagtgccccctcccattttccgctactgaccagttcatccagctttccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctccagtg

SEQ ID NO: 80178 - DNA, 1659 bp, Homo sapiens
acttcctccggcctcccgctctcacttccttctcgagcccggagccgctgccgccgcccccagctcccccgcctcggggagggcaccaggtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttccctgaatgcctttttctctgagtgcctttttctccttaaggaggcctgcagagaaaggggctttgggctctgcccccctctgcttgggaacactgggtattctcatgagctcatccaagccaaggttggacccctccccaagaggccaacccagtgccccctcccattttccgctactgaccagttcatccagctttccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctccagtgaaaaaaaaacaaaaaaaaagcaaaggaagaggaaaagagcgcgataagcacaagcgtgaggggacagaagacaaaacaaatagcaagacagaaaaacaaagggggcgcggcctaataaacactacccggcggcgggagcgcagataaaacagcagccacccggcggtggtatcaaaagacgcagccccaaagaggagcgataataaaaacaacagcaggggcgagcgaaaaacagagtggagagagaacaaccacctgagggcttgaggaaggaacccacactgtggggggaaaaacaagggaaacccacaaacaacgaccagcgagacaacaacgggatc

SEQ ID NO: 80179 - DNA, 1619 bp, Homo sapiens
acttcctccggcctcccgctctcacttccttctcgagcccggagccgctgccgccgcccccagctcccccgcctcggggagggcaccaggtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttccctgaatgcctttttctctgagtgcctttttctccttaaggaggcctgcagagaaaggggctttgggctctgcccccctctgcttgggaacactgggtattctcatgagctcatccaagccaaggttggacccctccccaagaggccaacccagtgccccctcccattttccgctactgaccagttcatccagctttccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctccagtgaaaaaaaaaaaaaaaaaactccagggggggccccgtacccaattctccctatttgaggtctattttcgaccctaacttggccttcctttttacaacgttctgattggtttacaactaccccttccctattagtgtgttaataaaattcaccccgtgtcagaaacctttgtcaaaagacacaaaggctttaacaggaagtacctttgataccctatcttcataccctcccttagatacaattcacatttataatttcgaccttatgtcggtttccccggtaccaagatttcttaagggaggc

SEQ ID NO: 80180 - DNA, 1295 bp, Homo sapiens
ccatcttttcttcccaataggcagaggcctccctaaccaagaatgtcccctttcatctgtccacaggtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttccctgaatgcctttttctctgagtgcctttttctccttaaggaggcctgcagagaaaggggctttgggctctgcccccctctgcttgggaacactgggtattctcatgagctcatccaagccaaggttggacccctccccaagaggccaacccagtgccccctcccattttccgctactgaccagttcatccagctttccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctccagtg

SEQ ID NO: 80181 - DNA, 914 bp, Homo sapiens
  misc_feature (91)..(91): n is a, c, g, or t
agagagagagagagagagagagagagagagagagagaggttcgccgaggctgttgcagggctgagcattcgaggtagcgcacacgtggatntgcttggccagtgcctggccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctccccaagaggccaacccagtgccccctcccattttccgctactgaccagttcatccagctttccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctccagtgaaaaaaaaaaaaaaaaaactccagggggggccccgtacccaattctccctatttgaggtctattttcgaccctaacttggccttcctttttacaacgttctgattggtttacaactaccccttccctattagtgtgttaataaaattcaccccgtgtcagaaacctttgtcaaaagacacaaaggctttaacaggaagtacctttgataccctatcttcataccctcccttagatacaattcacatttataatttcgaccttatgtcggtttccccggtaccaagatttcttaagggaggc

SEQ ID NO: 80182 - DNA, 395 bp, Homo sapiens
ccagccgtccagtttcgccgagatgaaacagaattctatttgggcaagagatgcgcttatgtatataagcaaagaacaacacagtcactcctggcggactgagagcccctaacctgaggcggcaccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctccagtg

SEQ ID NO: 80183 - DNA, 1611 bp, Homo sapiens
acttcctccggcctcccgctctcacttccttctcgagcccggagccgctgccgccgcccccagctcccccgcctcggggagggcaccaggtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcgcagagcgcagttgacgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccactgccctgatgtgcccatcctgctggtgggcaccaagaaggacctgagagcccagcctgacaccctacggcgcctcaaggagcagggccaggcgcccatcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctcagctgtgccttaaggactaattctggcacccctttccagggggttccctgaatgcctttttctctgagtgcctttttctccttaaggaggcctgcagagaaaggggctttgggctctgcccccctctgcttgggaacactgggtattctcatgagctcatccaagccaaggttggacccctccccaagaggccaacccagtgccccctcccattttccgctactgaccagttcatccagctttccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctccagtgaaaaaaaaaaaaaaaaaacaaacaacaaaaacacaaccaccaaaaaacaaaacaccaaaaacacccccccccccccacaccccaaaacaccccccaacccacacacaaaaaaaaaaccttcggggggggcccggaccccaattgccttaagggggcggcgttacccttcaggggccgcgttttaaaacgcgtgcttgggaaaaccctgtgggtcaccccattttatgcccttggagacaataccccttttcccgcgtgggaattcccagagggcccctacccgtcgccttttc

SEQ ID NO: 80184 - DNA, 613 bp, Homo sapiens
  misc_feature (91)..(91): n is a, c, g, or t
agagagagagagagagagagagagagagagagagagaggttcgccgaggctgttgcagggctgagcattcgaggtagcgcacacgtggatntgcttggccagtgcctggccctgcaacaggatggtgtcaaggaagtgttcgccgaggctgtccgggctgtgctcaaccccacgccgatcaagcgtgggcggtcctgcatcctcttgtgaccctggcacttggcttggaggctgcccctgccctccccccaccagttgtgccttggtgccttgtccgcctccccaagaggccaacccagtgccccctcccattttccgctactgaccagttcatccagctttccacacagttgttgctgcctattgtggtgccgcctcaggttaggggctctcagccatctctaacctctgccctcgctgctcttggaattgcgcccccaagatgctctctcccttctccaatgagggagccacagaatcctgagaaggtgaatgtgccctaacctgctcctctgtgcctaggccttacgcatttgctgactgactcagcccccatgcttctggggacctttcctacccccatcagcatcaataaaacctcctgtctccagtg

SEQ ID NO: 80185 - DNA, 863 bp, Homo sapiens
gcttcgcagcgtcggcgtctgtgcgtgggccaaacatcagggcctcgaccagggatacaagggcaaccgctaactagattcctgattcctgatggctggcggcggctgacaccaaaggtaaaaggccttttagggaaagaaaccatttgtgaaaagctcttgggctaaactcgctctgcaaactgggggcgcacgctcgtggccaaactctggcagtgggactatcccggagcacccgatccctggaatcatgttctggaaaccaccgcgacgtgcgcagttctcgggcgtggccctggtatcatcccactgaatcctaggaacgcggtgcggtaggtatcactgtccgcatttcacagaccgaagtccagaatggggaagcgacttgtcttaggcttcctggccacactggggaccgtggtcatggtagcgtccttggacacctgtctccaaggctctgcagaagggggaggtgccgggccctgacggctgatgtccaaggaccagccgggatggaccagccccaggaggccccagtggaggaaaacaggacgaggttttcagtaagatgatcttatactaattcaagggctataatttgttctccacatcgtgtgcctccaactttttcggggaaagggtgttaaaattccgttacagtgtttttacttgtcaaattagaagcagcaaccggctgggtgcagtgagtcaagcttggaatcccagcactttgggaggccaaggtgggcggattgcttgagctcaggagttggagatcgtggcatcgataacatggcagaacctcatctttgcaaaaaatacaaaaattagccaggcgtggtggcgcacgcctgtggtaccca

SEQ ID NO: 80186 - DNA, 1716 bp, Homo sapiens
gaacctttcttttccggattgggcatcccggcatctgcacgtggttatgctgccggagtttgggccgccactgtaggaaaagtaacttcagctgcagccccaaagcgagtgagccgagccggagccatggagggccagagcgtggaggagctgctcgcaaaggcagagcaggacgaggcagagaagttgcaacgcatcacggtgcacaaggagctggagctgcagtttgacctgggcaacctgctggcgtcggaccggaaccccccgaccgggctgcggtgcgccggacccacgccggaggccgagctacaggccctggcgcgggacaacacgcaactgctcatcaaccagctgtggcagctgcccacggagcgcgtggaagaggcgatagtggcgcggctgccggagcccaccacacgcctgccgcgagagaagcctctgccccgaccgcggccacttacacgctggcagcagttcgcgcgcctcaagggcatccgtcccaagaagaagaccaacctggtgtgggacgaggtgagtggccagtggcggcggcgctggggctaccagcgcgcccgggacgacaccaaagaatggctgattgaggtgcccggcaatgccgaccccttggaggaccagttcgccaagcggattcaggccaagaaggaaagggtggccaagaacgagctgaaccggctgcgtaacctggcccgcgcgcacaagatgcagctgcccagcgcggccggcttgcaccctaccggacaccagagtaaggaggagctgggccgcgccatgcaagtggccaaggtctccaccgcctctgtggggcgctttcaggagcgcctccccaaggagaaggtgccccggggctccggcaagaaaaggaagtttcaaccccttttcggggactttgcagccgagaaaaagaaccagttggagctgcttcgtgtcatgaacagcaagaagcctcagctggatgtgactagggccaccaataagcagatgagggaggaggaccaggaggaggccgccaagaggaggaaaatgagccagaagggcaagagaaagggaggccggcaggggcctgggggcaagaggaaagggggcccgcccagccagggagggaagaggaaagggggcttgggaggcaagatgaattctgggccgcctggcttgggtggcaagagaaaaggaggacagcgcccaggaggaaagaggaggaagtaatagtttctaactgtcggacccgtctgtaaaccaaggactatgaatactaaatgttaagttctaggcaattatacggggactcagaaggacctggccgctgccttcattgagtttaaagggacaggattgcccttccgtcaagaaagtatgtaagtgttggactgcacaaattaatgtttttcccacaaccgagactttggagattaagaacttatttgaggatttaagaattagggaaataatttggtggaaaccgggaatgagttctattcttaaacagcctttttttttctttttaatgttggatatacggcgaggtagagttggccatatttcagagacttagattgacgtatatgtttctgcattatttttacaacaagtttgtgtatcagagcgggagtgcgggggagggaaagaaaacaaacagtttcagaattgaataggcaagtgactgttttaaagattaagtaataaagatgtcttatctag

SEQ ID NO: 80187 - DNA, 1855 bp, Homo sapiens
gaacctttcttttccggattgggcatcccggcatctgcacgtggttatgctgccggagtttgggccgccactgtaggaaaagtaacttcagctgcagccccaaagcgagtgagccgagccggagccatggagggccagagcgtggaggagctgctcgcaaaggcagagcaggacgaggcagagaagttgcaacgcatcacggtgcacaaggagctggagctgcagtttgacctgggcaacctgctggcgtcggaccggaaccccccgaccgggctgcggtgcgccggacccacgccggaggccgagctacaggccctggcgcgggacaacacgcaactgctcatcaaccagctgtggcagctgcccacggagcgcgtggaagaggcgatagtggcgcggctgccggagcccaccacacgcctgccgcgagagaagcctctgccccgaccgcggccacttacacgctggcagcagttcgcgcgcctcaagggcatccgtcccaagaagaagaccaacctggtgtgggacgaggtgagtggccagtggcggcggcgctggggctaccagcgcgcccgggacgacaccaaagaatggctgattgaggtgcccggcaatgccgaccccttggaggaccagttcgccaagcggattcaggccaagaaggaaagggtggccaagaacgagctgaaccggctgcgtaacctggcccgcgcgcacaagatgcagctgcccagcgcggccggcttgcaccctaccggacaccagagtaaggaggagctgggccgcgccatgcaagtggccaaggtctccaccgcctctgtggggcgctttcaggagcgcctccccaaggagaaggtgccccggggctccggcaagaaaaggaagtttcaaccccttttcggggactttgcagccgagaaaaagaaccagttggagctgcttcgtgtcatgaacagcaagaagcctcagctggatgtgactagggccaccaataagcagatgagggaggaggaccaggaggaggccgccaagaggaggaaaatgagccagaagggcaagagaaagggaggccggcaggggcctgggggcaagaggaaagggggcccgcccagccagggagggaagaggaaagggggcttgggaggcaagatgaattctgggccgcctggcttgggtggcaagagaaaaggaggacagcgcccaggaggaaagaggaggaagtaatagtttctaactgtcggacccgtctgtaaaccaaggactatgaatactaaatgttaagttctaggcaattatacggggactcagaaggacctggccgctgccttcattgagtttaaagggacaggattgcccttccgtcaagaaagtatgtaagtgttggactgcacaaattaatgtttttcccacaaccgagactttggagattaagaacttatttgaggatttaagaattagggaaataatttggtggaaaccgggaatgagttctattcttaaacagcctttttttttctttttaatgttggatatacggcgaggtagagttggccatatttcagagacttagattgacgtatatgtttctgcattatttttacaacaagtttgtgtatcagagcgggagtgcgggggagggaaagaaaacaaacagtttcagaattgaataggcaagtgactgttttaaagattaagtaataaagatgtcttatctagaaaaaagaaaagaacgcaacataagaaaccaagaagaaagagagaagcgaaaagagggggaggcgcagacaggagaataaccgcggaagaggcaccacaaaagggaggacaagagaattgggtgaacgggggcgcccag

SEQ ID NO: 80188 - DNA, 546 bp, Homo sapiens
atctaacacaactctttacaaacaatgatgacaacttttttatattttaattgtgtctgcatctatcagagctctgaatccaacttaagtctccttttcttgactcattattacacaatttattgttttgttctaaagagttgcagataacactttgtttggaccataagatactaatatataaaaggaggaacatttatacatagctgttcaaattgcatgtctagatttgatatcctgagaaaaatgtacaactttaattaaaaatgtgtgaaatttcacattcaaagaaatcattaagagacgtgatagctaagtgcaatactccatcataggctggatactttcagagtgactaactgttatgttttatcttggactgataggtttccagggacacgggactttcagtgctaaaacatggacagtcaatcagactgctcatactggttctggaacacacacacacacacacgcacacacacacactcacaggagaaagaggaagggagagagaaaatgaataaattataaagcaaacagggc

SEQ ID NO: 80189 - DNA, 283 bp, Homo sapiens
cttgtttacaaaatacagcttgatttctctaatttttaccctttgattctagtccactcttggaatccaatcaaaataaaacaaatctaccttttgcataatagccctgcaaatatttgaagttagctcttgggttttccctaagtcttttgtaggctaaacattagttttggtaattaatataaaaaattagctttaatttcttctaggattaattaccttttttataagtattatactatttcgttaaatttttggatagtactttatcttacctaatcag

SEQ ID NO: 80190 - DNA, 588 bp, Homo sapiens
aaaataaaaagtcttaaaaataaatgttttctttgttttaaatctgggtcttcatgtatggagtatgcttataaagcaacaaattgggtaggacctgtacctttggaatcctgacatacatacatcacttaataaatcacactaccccagaaagaagcaggttattttggcctggctataattgaaaccaagatgaagagacttctgactttcagattaccccttagtttcccaatatacatttgactcagatgacctaaaaaataatcagttttcattgtctttagtagtgtgcaacaaaaaatgttattgctcgaaagaagtacgcacagtgcccaaatcatggttgacatagtaatttccttgaacatcctaaataagatctcatttgttaatgacttatcttttccaccctccttactttttatcttttctagcgacatattagtatatattctaaaaagcatttgtgtgtattgagaaaattcagttacaaaaaaaggtgactatttccgcttctgtatttgaaactgtggtggtgggctatggggaaagagagaataagaaggtggatttttatacatgttt

SEQ ID NO: 80191 - DNA, 148 bp, Homo sapiens
ggttggccagtcaggtcagaaccagggggattagggagactcaactatcgtccttcaccccagccaatacccatgagctcatccagtatttactcaccactcactatatccttgatctcacggggctgatgaagggagaggaagagtc

SEQ ID NO: 80192 - DNA, 571 bp, Homo sapiens
ggcttctgatgaaaagtctgttgccagacaaatcagagctcctttacatgttatcatgttattgtcttcttttctcttgttgcttttaggatcctttctttgttcttttttttttttttttttttttgagatggagtctcgatctcggctcactgcaacctccacctcctgggttgaagcagttcttctgcctcagcctcccgagtagctgagactacaggtatgtgccatcatgcccagctaactttttttttgtatttttagttaaagatggggtttcaccatgttggtcaggttggtcctgaactcctgacctcatgatccacccaccttggcctcccaaagtgctgggatcacaggtgtgagccaccgcgcctggccatttctttgttcttgacccttgagagtgcgattattatatgctttggggtggtcttatttggatctgaatctatttggtgatatttgaacttcctgtacctgtatatttatttctttctctaggtttagaaagttttctgctattatttcttggaataactttctacaccttgctatttctcaactccct

SEQ ID NO: 80193 - DNA, 721 bp, Homo sapiens
aggatgagactggctgagtcttctggtcttcatctttctcccatgctggatgcttcctgcccttgaacattggactgcaagttctttagcttttggacgtttggacttacaccagtggtttgccaggggctctcagaccttctgccacagactgaaggctgcactttcagcttccctacttttgaggttttggaactcggactggctttcttgctccgcagcttgcaggtggcctgttatgggactttaccttgtggatcataatcaagaaaaacttttttttaagctacttgtagcttttcacaattgagtaaggtatactcctgtaaacaaaatttggagcacattcgtctctctctacctgatttctccagaatttgaaaactagttgacaactttgtgccctgtcttccagtttaacatggagctttcagtctgtaatgcagaggatcctctagggtataactccacaaggcagaagacaagtttactgtggacaaaaaaatgggctagaatgtcttcagcttctcaggcccttaatagggctgatgatggatgactctactggagaaaaggaagacaaagaggtttcagatcatcaataaagcagctgactctcaagaaatggctggaaatcatatttaaagtcgatcttaaatgaatttgaaaaaaatgcacataaagatcgttacctgcctcgtttggacatatcagacctatg

SEQ ID NO: 80194 - DNA, 413 bp, Homo sapiens
agatgccaactggattatccaaaaatgggaaaaattacctcccagtgcctcctctgaagcatatttcacatatatttgggagtctctggtttcgtagatcttatgccttttctatttaatgaattaggtttgtcaaactgaattgcattccaaaaaagtcacttttttagaatactttaaaaagtgaaaatgaagattgaaaatgaatgaggataactatgttaaattgcttgcagcctatgttaaataggcttaattgaatgaatctcaggtcttttcttgccaggccagggacttcatggaaataagctcctagtacctagagactcacctaacaaatcatccagtccatgctctcccaggacagagtgactcccctgcccatttgcaccctgtccttgtacaggtttgct

SEQ ID NO: 80195 - DNA, 799 bp, Homo sapiens
accatcagtggggccctcaaccagttcccccaatcctgcagcaacatgccagccaagccagggcatctggggcaccctcagcagacagaagtggcacctgaccccaccacgatgggcaatcgccacagggaacttggggtccccgattcagccctggctggagtgccaccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcagctttggcctagtgcagccccggcctcccctcgagcccagccccactggccgccaccgtggggtacgtgctgtgagcagagctggcctacgccggcacaggccatgccatggctgccatgccgtccagtcaggaaacagcagaggctgtgccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctc

SEQ ID NO: 80196 - DNA, 611 bp, Homo sapiens
ggagctgggtgatggatacctgagggtggagatggctctcctttaagagctcccttcttatataaattaaaaaaaaaaaaattaaacccactctcaggacgagagagccgaggacaagggggatccgtttggacgtgaccgtcatcgtccagctggtcacctttctcctctcatgtgcctttgttcttcgggtccaagctagagagagtgtagagaatgaccacctgggttctgataaactctatttagactttcctatccacacacacgtagaaaacttcagattggggcattacgtgggttgagccagaacccagatccaaaagcgctcacccgggactgggacgggtcctgactccatccttgctgctgctgccgctgctgctgcccctcctccctctcctccaccaccacctcctcctcctgctccacttccttttttttgttgttttgttttgcttttaatttgttgctgttgttgttttaaatgtaacatggacttccccgccccctcatttttcccccatccaaatggcatagctccttttaggaacactgctggggtcgattgcgtgtccaacttccaaaataaaagatttttctaaactctt

SEQ ID NO: 80197 - DNA, 268 bp, Homo sapiens
aataccttttcaaattgccagtcaagagtgaagtatgccaagaaaaaaggagaggctcctcaataaccctcaagacataatgtcattttctctcctgtggatgaagactctctatctgctgaatatttattagtctgctgggtcacctgctagaaaacagacaattctccagcaacttcaaacactcttcttcactgaactacagtttggtatgagacgtcaaaggataagaatgtgcatacctaaatggtcaaatgaagatgaatgt

SEQ ID NO: 80198 - DNA, 231 bp, Homo sapiens
taacaaggaggaagagttatttgttggctagagggagagacttataaaattgccccccagttcatgttaagagagcttagtctggagtcatataagcctttttgttaatctcagtttcatcattccctaatctactggccttgggttagcggccttggattatctgatctttttgtacctcagtttctttctccacaaaatgaggagagcagtcgaccttccctgtagaat

SEQ ID NO: 80199 - DNA, 436 bp, Homo sapiens
ccaagatgacaaagaaaagaaggaacaacggtcgtgccaaaaagggccgccaccacgcgcagcctattcgccgcactaactgtgcccgatgtgtgcccaagggcaaggccattaagaaattcgtcattcgaaacatagtggaggccgcagcagtcagggacatttctgaagctagcgtcttcgatgcctgtgtgcttcccaagctgtatgtgaagctacattactgcgtgagttgtgcagttcacagcaaaatagtcaggaatcgatctcgtgaagcccgcaaggaccgaacacccccaccccgatttagacctgcgggtgctgccccacgtcccccatcaaagcccatgtaaggagctgagttcttaaagactgaagacagactattctctggagaaaaataaaatggaaattgtacttaaaaaaaaaaaaaaga

SEQ ID NO: 80200 - DNA, 420 bp, Homo sapiens
taaataaaaaacatcattaatttttcaaaaaggaaataaatttctctttgaaaatttgtagtccacacaatggatgtcttcaacacatggtttctttccaattccaccacattcctcagatattccaggcttcctgccttccccaccagcagacagattaggtatgtcagaaaagaaacccgatcaagccaatttcttccagatgatgggccaggggcacaggcctagatgctcacaagtgagttgaaggaggattgggtgatatactgcaaaccctcagtgtacaattttgtagctaccaggtcattttcttactattaaatgcttcagagttcttacatgtgtaaaccaaaaataaaattctaaggccccccaactatctgaatagactttctcctcagccagaactcttttaaaatt

SEQ ID NO: 80201 - DNA, 241 bp, Homo sapiens
atgaaatgttattcagttattaaaaaaatgaagttctaatacatgctacaacgtggataaactttgaaacattatgttaaatgagataagccatacacaaaaggataaatattatgtaatttcacttatctgaataaaaaatgtatagagatggaaagtataacagagtttactaggggctgtgctggaaaggggagaatggaaagctattatttaatgggtatagagtctctgttgggga

SEQ ID NO: 80202 - DNA, 217 bp, Homo sapiens
tacaggccccacctgcccacttatttatgtaagacactcagaatggtaatgcatagcatacagcaggcactcaataagtgccagctattgttactgacactcagagctcactggctctctccagcatactgagtgtccccaccaccaactgaatcccaaggggagggctcacccccgctggctagtccctctatggtcctagggtgcccttctgggg

SEQ ID NO: 80203 - DNA, 398 bp, Homo sapiens
ctatgctatcctaaaatggtagccatctttttgtttatttttaattaaattccatccagataagggatcctcatcttctttcatatgggcttttcggactgccactgatccatgtaccagataaacaaaacaccttccaaattcaatccatttgggatagctactttcaaaagcagtgttttaagaatcagataactcctaatatcttttggtagggaaagggaaattcctatttattttagtggctggaattacctctgaggcctgagagaaaagttaccccccaaagaaggagaatgtaatctaattcttcctgagtgcttgcactagggaaagtaagcagctgtctgttgtcatttgaagggctctgtgacagctccctaccctttaaaataagc

SEQ ID NO: 80204 - DNA, 435 bp, Homo sapiens
ggtacagatttgggaaaggaaaccaggaattctgttttggatggaaatcagtaactcagtaagtttgaggtgtccacatgtggcgagctgcctcctggataccaagatatacagatctgggctttattctgcccaccaaatcctttactgaggtactctcttgccaaagcacacgtaggaacaagaaaagaggtaaaaaggaggaagattagagaccattctcgcccttaaggatgttgaaatctgagaagggaagaagggaggcttttcggcacctattgcagagcctgagctggaacagcaggtgctgccttgctcatctgacacttggaaaggtatcagcagcaaaacaagatggggacattcaaaaactggttcttagaaacaaaaacatactgccatgttgaccatctggttcctggctacagcagacaa

SEQ ID NO: 80205 - DNA, 958 bp, Homo sapiens
ggaactatggctgggcggggtggctcacacctgtaatctcagcactttgggaggccaaggtgggcggatcacctgaggtcaggagttcaagaccagcctggccaacacagtgaaaccctgcctctactaaaaatacaaaaattagccaggtgtggtggcacgctcctgtaatcccagctacttgggatgctgaagcaggagaatctcttgaacctgggaggcagaggttgcagggagttgagattgtcgagtatagtggattgagtgctgtggagccgagattgccaagtgcagtggatcgagtccactgcactccagtctgggcaatagagctaaactcagtctcaaaaaaaataataaaggaaaaagtaagtcagaggcgcaaaatcaatccttatttcctttaacctaggaataatagcatatttcactttcatagaaattgaactcttagagaaccagatccttctataccttttgttctgtaaactgctatttatttacttatttttgcctcacatattgtgcatatccttcttcattaacttaaaaagaactcctgagctcaggtgatacacacacctcagcaaatcttttaaattatacattctgtgatatttccttgactttcttatccagcactcgtattgattatttacatttggatcatgtagggtattaaacactcctttatgatggcaaatttccaaaaatacacaaaagtagagcacagaatggtatactaaacccactcagtctacacggattgggtcacctaagtaccagttaaattacgatgctttgactccacacaagtacccccaaccaagggcttcagaaatatttgaaaggcacattccagcacgtcgtattttactcataccatttccctaggttcgtaatcttgacgagactcgttcaacagactgtagctactatccagaatggacgaaaaatc

SEQ ID NO: 80206 - DNA, 223 bp, Homo sapiens
gcctaccctaagacgagacatctaatgacagatcttgggagaactgtgccatcagagcctgagagcacccatagacaccaccagatcagccaggcgcggtggctcacgcctgtaatcccagcactttgggaggccgaggcgggaggatcacctgcggttgggagttcgagaccagcctgacgaacatggagaaaccttgtctctactaaaaatacaaaaaatt

SEQ ID NO: 80207 - DNA, 590 bp, Homo sapiens
  misc_feature (447)..(447): n is a, c, g, or t
  misc_feature (493)..(493): n is a, c, g, or t
  misc_feature (500)..(500): n is a, c, g, or t
tggttcagaagcaaccaccaggcatctctgcacaaatttgccagctaagatcagtataggccctcctccaacttatctgcaatgcactgggagaatatatcttcatatctatttagaaacatgcatataagttattttaatactatttatacaattttagcattttcctagagtaggttttccactttcatcacccacagctacaaaattattcagttattttctacagttttacaaatataccatattacgggctgcttaatatcttccttgtttaagactttaacagtatcagccgggcgtggtggctcacgcttgtaatcccagctctttgggaggcgggcagatcatgagctcaggagttcgagaccagcctggccagtatggtgaaaccctgtctctactaaaaatgcagaaattagttgggcgtggtggtgcgcgcctgtngtcccagctactcgggagactgaggcagaggagtcgcttgaatccnggaggcngagcttgcagtgagccgagatcatgccactgcactccagcctgggcaacagagtgagactctgtctcaaaacaagcaaacaaaaaaaaaa

SEQ ID NO: 80208 - DNA, 1436 bp, Homo sapiens
aatatcttgtattattatacaatgcagtattcaaatttgtccttgtagtgcagagatgactgataatttctaaaagattcgatccttaaaacttgtttccaagcagacttataaggaagctgatttttgagtcagaggccttaaacgtgtcatatacaagtggcatcattttaagtccaaagtgaaacacttgatttgaataagctagtttataaactaaagctgttttcttatgttacagtatttcagcacatttcattccacataaaaagaatattaagtgtccctggttgtgggagagtgtttatttttctcaaaattatctagcattttgcttacagtgctttgaatgtttgacttaaaattattattgatgttgaattgtagggtgctgatttaggtcttgattcatacacatttaaaggaggttggtaaccccctcatggtagagtgaagggagaaaagggccaagaagacaaagtaccactgataaagaagagattgtcaaatagatgcattcctagtcatgaattacccttttccaaacatttttaaagcaatgccttgtgtcaactcaacccttcttccccatttcttgtcatagaatgtagcatggccataggtgaaaaagcttatcattaaagtatgaaaccatgaattataagcattttgccatgatgcccttttatacatatgtttttaaaagtactaaccaacatataggagtttaggaatggtgaagatataatttgattaagttgtaggtaaacagaaaggatcatcttaggctcagaatttctaatatgattacatgagtctactttataaactggtataggctatgtaattagcccgtaagttacttaaaggaccaggggacctaatttttgtcagttttccagtcacattggtgccattcaggactccagctgtttacaggaaatatgtacttagcagaatagtatttttccttgaaaaaaatttgaattcagcctaaatacagaatgaatatgaatagtttgtgaaaagggttagagaacaacaatattcctatagtttctgtattaatgcagtagagacagaggttcctaacgcaaaaagaaaaccacaagtaaagaccgtcaaattagagctttagaatatgacttgaaaaagtagggatgggcaaaacagcataagaaaatattttttcttaatgcagatggacagtgttttcttgttttaaaaatgttttgcctatttgccagcattttttgaagtaatacactgctgctacctggaagatgtctaacttcattttctacaactcttatgtgattttgccattgtcattaagatgcattgattttatttatgaggtgtatgactttaaatatctaaatgctgtattaagtgacttgtttcaaaggaataaatgaagtgaaaacgtaaaaaaa

SEQ ID NO: 80209 - DNA, 1452 bp, Homo sapiens
aatatcttgtattattatacaatgcagtattcaaatttgtccttgtagtgcagagatgactgataatttctaaaagattcgatccttaaaacttgtttccaagcagacttataaggaagctgatttttgagtcagaggccttaaacgtgtcatatacaagtggcatcattttaagtccaaagtgaaacacttgatttgaataagctagtttataaactaaagctgttttcttatgttacagtatttcagcacatttcattccacataaaaagaatattaagtgtccctggttgtgggagagtgtttatttttctcaaaattatctagcattttgcttacagtgctttgaatgtttgacttaaaattattattgatgttgaattgtagggtgctgatttaggtcttgattcatacacatttaaaggaggttggtaaccccctcatggtagagtgaagggagaaaagggccaagaagacaaagtaccactgataaagaagagattgtcaaatagatgcattcctagtcatgaattacccttttccaaacatttttaaagcaatgccttgtgtcaactcaacccttcttccccatttcttgtcatagaatgtagcatggccataggtgaaaaagcttatcattaaagtatgaaaccatgaattataagcattttgccatgatgcccttttatacatatgtttttaaaagtactaaccaacatataggagtttaggaatggtgaagatataatttgattaagttgtaggtaaacagaaaggatcatcttaggctcagaatttctaatatgattacatgagtctactttataaactggtataggctatgtaattagcccgtaagttacttaaaggaccaggggacctaatttttgtcagttttccagtcacattggtgccattcaggactccagctgtttacaggaaatatgtacttagcagaatagtatttttccttgaaaaaaatttgaattcagcctaaatacagaatgaatatgaatagtttgtgaaaagggttagagaacaacaatattcctatagtttctgtattaatgcagtagagacagaggttcctaacgcaaaaagaaaaccacaagtaaagaccgtcaaattagagctttagaatatgacttgaaaaagtagggatgggcaaaacagcataagaaaatattttttcttaatgcagatggacagtgttttcttgttttaaaaatgttttgcctatttgccagcattttttgaagtaatacactgctgctacctggaagatgtctaacttcattttctacaactcttatgtgattttgccattgtcattaagatgcattgattttatttatgaggtgtatgactttaaatatctaaatgctgtattaagtgacttgtttcacttcatttattcctttgaaactcgtgccgaattcggcacgagcggca

SEQ ID NO: 80210 - DNA, 440 bp, Homo sapiens
ttgaacttgatgaagagagcattgtactttctggcatcctatcaagaactgagagcactatgggagaacagacccagctcccctcacccaatccccagaaaagctgggagtgagaacagaggtgagtggatgggttctgtgagaggccttctggctggaacactgcttcagagcatgccagcaggaagtgagaagtgcccgggctcatctcgctggggcttgggacacagctctaccgactgtctcttggctgcgtccgcaaacataaacacgtgaagtgggagcaaatgtcatggtaaaggcagatcaagacaactccatctgttgacttattattagacaacaaatgtcatgggaagaaaatgtgccccaagtaatttagccccgttgaaactcaacaggcttccgctggttggaatgagaactcttcctacctctcc

SEQ ID NO: 80211 - DNA, 3015 bp, Homo sapiens
aggcgggcaccaggcgcgggtccctccgggcaggggaggtaggcctgggcctgacgccggccacgcagcggcgggagagtgagcactcgggcggcggcgtcctggagacccgcgagagatggaagcggcggcgacgccggcggctgccggggcggcgaggcgcgaggagctagatatggatgtaatgaggcccttgataaatgagcagaattttgatgggacatcagatgaagaacatgagcaagagcttctgcctgttcagaagcattaccaacttgatgatcaagagggcatttcatttgtacaaactcttatgcaccttcttaaaggaaatattggaactggccttttaggacttccattggcaataaaaaatgcaggcatagtgcttggaccaatcagccttgtgtttataggaattatttctgttcactgtatgcacatattggtacgttgcagtcactttctatgtctgaggtttaaaaagtcaacattaggttatagtgacactgtgagctttgctatggaagtgagtccttggagttgtcttcagaagcaagcagcatgggggcggagtgtggttgacttttttctggtgataacacagctgggattctgtagtgtttatattgtcttcttagctgaaaatgtgaaacaagttcatgaaggattcctggagagtaaagtgtttatttcaaatagtaccaattcatcaaacccttgtgagagaagaagtgttgacctaaggatatatatgctttgctttcttccatttataattcttttggtcttcattcgtgaactaaagaatctatttgtactttcattccttgccaacgtttccatggctgtcagtcttgtgataatttaccagtatgttgtcaggaacatgccagatccccacaaccttccaatagtggctggttggaagaaatacccactcttttttggtactgctgtatttgcttttgaaggcataggagtggtccttccactggaaaaccaaatgaaagaatcaaagcgtttccctcaagcgttgaatattggcatggggattgttacaactttgtatgtaacattagctactttaggatatatgtgtttccatgatgaaatcaaaggcagcataactttaaatcttccccaagatgtatggttatatcaatcagtgaaaattctatattcctttggcatttttgtgacatattcaattcagttctatgttccagcagagatcattatccctgggatcacatccaaatttcatactaaatggaagcaaatctgtgaatttgggataagatccttcttggttagtattacttgtgccggagcaattcttattcctcgtttagacattgtgatttccttcgttggagctgtgagcagcagcacattggccctaatcctgccacctttggttgaaattcttacattttcgaaggaacattataatatatggatggtcctgaaaaatatttctatagcattcactggagttgttggcttcttattaggtacatatataactgttgaagaaattatttatcctactcccaaagttgtagctggcactccacagagtccttttctaaatttgaattcaacatgcttaacatctggtttgaaatagtaaaagcagaatcatgagtcttctatttttgtcccatttctgaaaattatcaagataactagtaaaatacattgctatatacataaaaatggtaacaaactctgttttctttggcacgatattaatattttggaagtaatcataactctttaccagtagtggtaaacctatgaaaaatccttgcttttaagtgttagcaatagttcaaaaaattaagttctgaaaattgaaaaaattaaaatgtaaaaaaattaaagaataaaaatacttctattattcttttatctcagtaagaaataccttaaccaagatatctctcttttatgctactcttttgccactcacttgagaacagaataggatttcaacaataagagaataaaataagaacatgtataacaaaaagctctctccagatcatccctgtgaatgccaaagtaaactttatgtacagtgtaaaaaaaaaaaaatctcagttatgtttttattagccaaattctaatgattggctcctggaagtatagaaaactcccattaacataatataagcatcagaaaattgcaaacactagaattaattttacactctaatggtagttgatcttcatagtcaagaggcactgttcaagatcatgacttagtgtttcaatgaaatttgaaaagggactttaaaacttatccagtgcaactcccttgtttttcgtcagaggaaaaggaggcctagaaaggttaagtaacttggtcgagaccactcagccttgagatcaagaaaacctaatcttctgactcccaggccaggatgttttatttctcacatcatgtccaagaaaaagaataaattatgttcagcttaattttagtgttgaatctatttgattatattttaatactttgaaaatgaatgtgtgatttttaatagtatatgtgacctgagcagaaaatcagggaactccaagaagcctacactgtggccatataaacctcagcaagagaaagaagctatgttcttttaaaacagaatagagaccgcttgctggtgaaactcctggctagtaagatgtgtgtctagctatactatttgtggcttgagcttttttaattattaccttcctttcctgagttttgtaggcaccacattcctgaatggcagaaaatagacacctcagaaaacggaggatttgtggactctttccagccctgtggcttttcttatcacagccttttatttattatgagcagaataaaagaatcagctaggtgtggtggtctgtgcttataatcccagctactctggaggataagttgggaggatcacttgagaggccaggagcttgagaccagcctgggcagcatagtgagacctcgactctataaaacataaa

SEQ ID NO: 80212 - DNA, 2941 bp, Homo sapiens
aggcgggcaccaggcgcgggtccctccgggcaggggaggtaggcctgggcctgacgccggccacgcagcggcgggagagtgagcactcgggcggcggcgtcctggagacccgcgagagatggaagcggcggcgacgccggcggctgccggggcggcgaggcgcgaggagctagatatggatgtaatgaggcccttgataaatgagcagaattttgatgggacatcagatgaagaacatgagcaagagcttctgcctgttcagaagcattaccaacttgatgatcaagagggcatttcatttgtacaaactcttatgcaccttcttaaaggaaatattggaactggccttttaggacttccattggcaataaaaaatgcaggcatagtgcttggaccaatcagccttgtgtttataggaattatttctgttcactgtatgcacatattggtacgttgcagtcactttctatgtctgaggtttaaaaagtcaacattaggttatagtgacactgtgagctttgctatggaagtgagtccttggagttgtcttcagaagcaagcagcatgggggcggagtgtggttgacttttttctggtgataacacagctgggattctgtagtgtttatattgtcttcttagctgaaaatgtgaaacaagttcatgaaggattcctggagagtaaagtgtttatttcaaatagtaccaattcatcaaacccttgtgagagaagaagtgttgacctaaggatatatatgctttgctttcttccatttataattcttttggtcttcattcgtgaactaaagaatctatttgtactttcattccttgccaacgtttccatggctgtcagtcttgtgataatttaccagtatgttgtcaggaacatgccagatccccacaaccttccaatagtggctggttggaagaaatacccactcttttttggtactgctgtatttgcttttgaaggcataggagtggtccttccactggaaaaccaaatgaaagaatcaaagcgtttccctcaagcgttgaatattggcatggggattgttacaactttgtatgtaacattagctactttaggatatatgtgtttccatgatgaaatcaaaggcagcataactttaaatcttccccaagatgtatgcagagatcattatccctgggatcacatccaaatttcatactaaatggaagcaaatctgtgaatttgggataagatccttcttggttagtattacttgtgccggagcaattcttattcctcgtttagacattgtgatttccttcgttggagctgtgagcagcagcacattggccctaatcctgccacctttggttgaaattcttacattttcgaaggaacattataatatatggatggtcctgaaaaatatttctatagcattcactggagttgttggcttcttattaggtacatatataactgttgaagaaattatttatcctactcccaaagttgtagctggcactccacagagtccttttctaaatttgaattcaacatgcttaacatctggtttgaaatagtaaaagcagaatcatgagtcttctatttttgtcccatttctgaaaattatcaagataactagtaaaatacattgctatatacataaaaatggtaacaaactctgttttctttggcacgatattaatattttggaagtaatcataactctttaccagtagtggtaaacctatgaaaaatccttgcttttaagtgttagcaatagttcaaaaaattaagttctgaaaattgaaaaaattaaaatgtaaaaaaattaaagaataaaaatacttctattattcttttatctcagtaagaaataccttaaccaagatatctctcttttatgctactcttttgccactcacttgagaacagaataggatttcaacaataagagaataaaataagaacatgtataacaaaaagctctctccagatcatccctgtgaatgccaaagtaaactttatgtacagtgtaaaaaaaaaaaaatctcagttatgtttttattagccaaattctaatgattggctcctggaagtatagaaaactcccattaacataatataagcatcagaaaattgcaaacactagaattaattttacactctaatggtagttgatcttcatagtcaagaggcactgttcaagatcatgacttagtgtttcaatgaaatttgaaaagggactttaaaacttatccagtgcaactcccttgtttttcgtcagaggaaaaggaggcctagaaaggttaagtaacttggtcgagaccactcagccttgagatcaagaaaacctaatcttctgactcccaggccaggatgttttatttctcacatcatgtccaagaaaaagaataaattatgttcagcttaattttagtgttgaatctatttgattatattttaatactttgaaaatgaatgtgtgatttttaatagtatatgtgacctgagcagaaaatcagggaactccaagaagcctacactgtggccatataaacctcagcaagagaaagaagctatgttcttttaaaacagaatagagaccgcttgctggtgaaactcctggctagtaagatgtgtgtctagctatactatttgtggcttgagcttttttaattattaccttcctttcctgagttttgtaggcaccacattcctgaatggcagaaaatagacacctcagaaaacggaggatttgtggactctttccagccctgtggcttttcttatcacagccttttatttattatgagcagaataaaagaatcagctaggtgtggtggtctgtgcttataatcccagctactctggaggataagttgggaggatcacttgagaggccaggagcttgagaccagcctgggcagcatagtgagacctcgactctataaaacataaa

SEQ ID NO: 80213 - DNA, 361 bp, Homo sapiens
taagaaaaataaatgtattttcattttctaggtgccggagcaattcttattcctcgtttagacattgtgatttccttcgttggagctgtgagcagcagcacattggccctaatcctgccacctttggttgaaattcttacattttcgaaggaacattataatatatggatggtcctgaaaaatatttctatagcattcactggagttgttggcttcttattaggtacatatataactgttgaagaaattatttatcctactcccaaagttgtagctggcactccacagagtccttttctaaatttgaattcaacatgcttaacatctggtttgaaatagtaaaagcagaatcatgagtctt

SEQ ID NO: 80214 - DNA, 774 bp, Homo sapiens
aggcgggcaccaggcgcgggtccctccgggcaggggaggtaggcctgggcctgacgccggccacgcagcggcgggagagtgagcactcgggcggcggcgtcctggagacccgcgagagatggaagcggcggcgacgccggcggctgccggggcggcgaggcgcgaggagctagatatggatgtaatgaggcccttgataaatgagcagaattttgatgggacatcagatgaagaacatgagcaagagcttctgcctgttcagaagcattaccaacttgatgatcaagagggcatttcgtaagtgttatggtttataagtctccttttcttttaattcagtatgtattttgtaatcttcttctacaggcaagacattctattacattacaagacacaaatataagacatagtctccaccttcaatgagtttatagtctatttgggaaagaaatgcgtttaaatcacagagcagtgtataggaattactggagtgatgatgcgtaacaaatgctagggatcttgaaagaagggagatctgattaagtggaacaggaatgttaagagaagtgatgtctgaaatgatcaggaggtagtacatgcttctttatactgaaacaaagtcgtggaggtagaaatgcattgtaacttttgaaaaccttttttgacattttgtcatcgttaatagatttgagtaacttctcattctaataatagtttaatggttcagcaaagtaatatgcaattgatcagaaaagaagaatataaactgaaaaa

SEQ ID NO: 80215 - DNA, 2486 bp, Homo sapiens
aggcgggcaccaggcgcgggtccctccgggcaggggaggtaggcctgggcctgacgccggccacgcagcggcgggagagtgagcactcgggcggcggcgtcctggagacccgcgagagatggaagcggcggcgacgccggcggctgccggggcggcgaggcgcgaggagctagatatggatgtaatgaggcccttgataaatgagcagaattttgatgggacatcagatgaagaacatgagcaagagcttctgcctgttcagaagcattaccaacttgatgatcaagagggcatttcatttgtacaaactcttatgcaccttcttaaaggaaatattggaactggccttttaggacttccattggcaataaaaaatgcaggcatagtgcttggaccaatcagccttgtgtttataggaattatttctgttcactgtatgcacatattggtacgttgcagtcactttctatgtctgaggtttaaaaagtcaacattaggttatagtgacactgtgagctttgctatggaagtgagtccttggagttgtcttcagaagcaagcagcatgggggcggagtgtggttgacttttttctggtgataacacagctgggattctgtagtgtttatattgtcttcttagctgaaaatgtgaaacaagttcatgaaggattcctggagagtaaagtgtttatttcaaatagtaccaattcatcaaacccttgtgagagaagaagtgttgacctaaggatatatatgctttgctttcttccatttataattcttttggtcttcattcgtgaactaaagaatctatttgtactttcattccttgccaacgtttccatggctgtcagtcttgtgataatttaccagtatgttgtcaggaacatgccagatccccacaaccttccaatagtggctggttggaagaaatacccactcttttttggtactgctgtatttgcttttgaaggcataggagtggtccttccactggaaaaccaaatgaaagaatcaaagcgtttccctcaagcgttgaatattggcatggggattgttacaactttgtatgtaacattagctactttaggatatatgtgtttccatgatgaaatcaaaggcagcataactttaaatcttccccaagatgtatggttatatcaatcagtgaaaattctatattcctttggcatttttgtgacatattcaattcagttctatgttccagcagagatcattatccctgggatcacatccaaatttcatactaaatggaagcaaatctgtgaatttgggataagatccttcttggttagtattacttgtgccggagcaattcttattcctcgtttagacattgtgatttccttcgttggagctgtgagcagcagcacattggccctaatcctgccacctttggttgaaattcttacattttcgaaggaacattataatatatggatggtcctgaaaaatatttctatagcattcactggagttgttggcttcttattaggtacatatataactgttgaagaaattatttatcctactcccaaagttgtagctggcactccacagagtccttttctaaatttgaattcaacatgcttaacatctggtttgaaatagtaaaagcagaatcatgagtcttctatttttgtcccatttctgaaaattatcaagataactagtaaaatacattgctatatacataaaaatggtaacaaactctgttttctttggcacgatattaatattttggaagtaatcataactctttaccagtagtggtaaacctatgaaaaatccttgcttttaagtgttagcaatagttcaaaaaattaagttctgaaaattgaaaaaattaaaatgtaaaaaaattaaagaataaaaatacttctattattcttttatctcagtaagaaataccttaaccaagatatctctcttttatgctactcttttgccactcacttgagaacagaataggatttcaacaataagagaataaaataagaacatgtataacaaaaagctctctccagatcatccctgtgaatgccaaagtaaactttatgtacagtgtaaaaaaaaaaaaatctcagttatgtttttattagccaaattctaatgattggctcctggaagtatagaaaactcccattaacataatataagcatcagaaaattgcaaacactagaattaattttacactctaatggtagttgatcttcatagtcaagaggcactgttcaagatcatgacttagtgtttcaatgaaatttgaaaagggactttaaaacttatccagtgcaactcccttgtttttcgtcagaggaaaaggaggcctagaaaggttaagtaacttggtcgagaccactcagccttgagatcaagaaaacctaatcttctgactcccaggccaggatgttttatttctcacatcatgtccaagaaaaagaataaattatgttcagctta

SEQ ID NO: 80216 - DNA, 2058 bp, Homo sapiens
aggcgggcaccaggcgcgggtccctccgggcaggggaggtaggcctgggcctgacgccggccacgcagcggcgggagagtgagcactcgggcggcggcgtcctggagacccgcgagagatggaagcggcggcgacgccggcggctgccggggcggcgaggcgcgaggagctagatatggatgtaatgaggcccttgataaatgagcagaattttgatgggacatcagatgaagaacatgagcaagagcttctgcctgttcagaagcattaccaacttgatgatcaagagggcatttcatttgtacaaactcttatgcaccttcttaaaggaaatattggaactggccttttaggacttccattggcaataaaaaatgcaggcatagtgcttggaccaatcagccttgtgtttataggaattatttctgttcactgtatgcacatattggtacgttgcagtcactttctatgtctgaggtttaaaaagtcaacattaggttatagtgacactgtgagctttgctatggaagtgagtccttggagttgtcttcagaagcaagcagcatgggggcggagtgtggttgacttttttctggtgataacacagctgggattctgtagtgtttatattgtcttcttagctgaaaatgtgaaacaagttcatgaaggattcctggagagtaaagtgtttatttcaaatagtaccaattcatcaaacccttgtgagagaagaagtgttgacctaaggatatatatgctttgctttcttccatttataattcttttggtcttcattcgtgaactaaagaatctatttgtactttcattccttgccaacgtttccatggctgtcagtcttgtgataatttaccagtatgttgtcaggaacatgccagatccccacaaccttccaatagtggctggttggaagaaatacccactcttttttggtactgctgtatttgcttttgaaggcataggagtggtccttccactggaaaaccaaatgaaagaatcaaagcgtttccctcaagcgttgaatattggcatggggattgttacaactttgtatgtaacattagctactttaggatatatgtgtttccatgatgaaatcaaaggcagcataactttaaatcttccccaagatgtatggttatatcaatcagtgaaaattctatattcctttggcatttttgtgacatattcaattcagttctatgttccagcagagatcattatccctgggatcacatccaaatttcatactaaatggaagcaaatctgtgaatttgggataagatccttcttggttagtattacttgtgccggagcaattcttattcctcgtttagacattgtgatttccttcgttggagctgtgagcagcagcacattggccctaatcctgccacctttggttgaaattcttacattttcgaaggaacattataatatatggatggtcctgaaaaatatttctatagcattcactggagttgttggcttcttattaggtacatatataactgttgaagaaattatttatcctactcccaaagttgtagctggcactccacagagtccttttctaaatttgaattcaacatgcttaacatctggtttgaaatagtaaaagcagaatcatgagtcttctatttttgtcccatttctgaaaattatcaagataactagtaaaatacattgctatatacataaaaatggtaacaaactctgttttctttggcacgatattaatattttggaagtaatcataactctttaccagtagtggtaaacctatgaaaaatccttgcttttaagtgttagcaatagttcaaaaaattaagttctgaaaattgaaaaaattaaaatgtaaaaaaattaaagaataaaaatacttctatttcgaaaaaaaaaaaaaaaaaaattggggcggcgggccacaaaagttttaaacattggtgggggggccaaggaaggaatggcagggcggaaacgcgggagggggttcaacaaggcgggaggggtgaacaagggggggttggaaagaggggt

SEQ ID NO: 80217 - DNA, 2299 bp, Homo sapiens
ggataaaagcaagtttaaaacaaaaattaggaggttgtatgatatagctaatgttctgagtagcctggatcttatcaagaaagttcatgttacagaggaaagaggccgaaaaccagctttcaaatggaccggcccagaaatcagtccaaataccagtggctccagcccagtcattcattttactccctctgatttggaggtgagacggtcttcaaaagagaactgtgccaaaaacctcttttccacacgtgggaaaccaaactttactcgacacccatctcttatcaaattggtaaagagtatagaaagtgatcggagaaagataaattctgcgcccagtagccctatcaagaccaacaaagctgagagttctcagaattctgcacccttcccaagtaaaatggctcagctcgcagctatttgtaaaatgcagttagaagagcaatcaagtgaatccagacagaaagtgaaagtacagctggcaagatctggaccctgcaaaccagtagcccctctggaccccccagtgaatgctgagatggagctgacagcaccgtccctcatccagcccctgggaatggttcccctgatccccagccccttgtcatcagcagtgcccctgatcctacctcaggccccttcaggcccatcctatgccatctacctgcagcccactcaagcccaccaaagtgtgacgccaccccaaggcctgagcccaacggtgtgcaccacccactcttctaaagctactggctcaaaagactccacagatgccaccactgagaaggcagccaatgatacctcaaaggccagtgcctctaccaggcctggaagcttgctgccagcaccagagaggcaaggggcaaagagccgaaccagggagccagctggagaaagaggctcaaagagggcaagcatgctcgaggacagtggttccaaaaagaaatttaaagaggacctaaaaggacttgaaaatgtctccgcaaccttgttcccatcaggatacctaatccctctcacgcagtgctcatccctgggggcagagtccattttgtctggtaaagaaaactcaagtgctctttccccaaaccacaggatttacagctccccaattgcaggtgttattccagtgacatcatctgaactcactgctgttaattttccctcttttcatgtaacaccgttgaagctaatggtctcaccaacttccgtggcagccgtacctgtcgggaacagcccggctctcgcttcaagccaccctgttcccatccagaacccaagctcagccattgtaaacttcaccctgcagcacctgggactcatctcacccaatgtgcagttgtctgccagccctgggtctggaatcgttcctgtgtctccaagaatagagtctgttaatgtcgcaccagaaaatgcaggcactcagcaaggaagggccaccaactatgactcaccagtcccaggccagagccagccaaatggacaatcagttgctgtgacaggggcacaacagcctgttcctgtgacacccaaagggtcacaattagtggccgaaagtttcttccgtaccccaggtggacccaccaagccaaccagctcatcctgcatggattttgagggtgctaataaaacctccttaggaactctctttgtcccacagcgaaaactggaagtctcaacagaggatgtccattaatcaacagatgttggcttagtttaattttctaaagagttgtttaatagagaaaatgtacacagactgatttggagaacacattctctgaaaatactgtaaatacgttggggatttgttcaatgtgaaatcagatagttgttttcatacatatatatatatatacacacacacacacacacacacacacacatatatttgtataaagctaagtttagctttcaatcctacaaaataaaagtaaaatgttgaactctaagatatattaacttctagggggaaaaatccattattttagctatgcctatactattatgcaaagtaactgtattaaagtttacttccctctaagcaagtatgcttgacatgcctaacacagcattcccttaaacattttgcacaaagaaaatgctgtgtgatgtataatgttgtatttttaaataggggtatagctatattttttgtaatttctttaatctgttgttgcagtgtatctttttgtaaagtttgcaacaatcctcaatcaagtctatggaaaaattatttataaaatgtatttttaatcataagttgttcaaattaaaacttttctaaaatataaaagca

SEQ ID NO: 80218 - DNA, 1634 bp, Homo sapiens
agagttaagttatcagtttaagagtggtgtgctggatgaatccttacccctaagcagggtcagtgccatcatccaaaggtgtcctaagaccacaggtggcatttaagaaacatgttctgtattattcggggcaagcattggaaagggtgggagggtattctcctctaggagccaggtgaccagcctgcctgcagcccactccgctggaggctttggtccaatgaggcaaccaccaagggatattagtcctgaaagaggcacgtggccatttttcttcctgtatttgtgtgtaaaataaacccttcctccttgttttctagaccttgttcccatcaggatacctaatccctctcacgcagtgctcatccctgggggcagagtccattttgtctggtaaagaaaactcaagtgctctttccccaaaccacaggatttacagctccccaattgcaggtgttattccagtgacatcatctgaactcactgctgttaattttccctcttttcatgtaacaccgttgaagctaatggtctcaccaacttccgtggcagccgtacctgtcgggaacagcccggctctcgcttcaagccaccctgttcccatccagaacccaagctcagccattgtaaacttcaccctgcagcacctgggactcatctcacccaatgtgcagttgtctgccagccctgggtctggaatcgttcctgtgtctccaagaatagagtctgttaatgtcgcaccagaaaatgcaggcactcagcaaggaagggccaccaactatgactcaccagtcccaggccagagccagccaaatggacaatcagttgctgtgacaggggcacaacagcctgttcctgtgacacccaaagggtcacaattagtggccgaaagtttcttccgtaccccaggtggacccaccaagccaaccagctcatcctgcatggattttgagggtgctaataaaacctccttaggaactctctttgtcccacagcgaaaactggaagtctcaacagaggatgtccattaatcaacagatgttggcttagtttaattttctaaagagttgtttaatagagaaaatgtacacagactgatttggagaacacattctctgaaaatactgtaaatacgttggggatttgttcaatgtgaaatcagatagttgttttcatacatatatatatatatacacacacacacacacacacacacacacatatatttgtataaagctaagtttagctttcaatcctacaaaataaaagtaaaatgttgaactctaagatatattaacttctagggggaaaaatccattattttagctatgcctatactattatgcaaagtaactgtattaaagtttacttccctctaagcaagtatgcttgacatgcctaacacagcattcccttaaacattttgcacaaagaaaatgctgtgtgatgtataatgttgtatttttaaataggggtatagctatattttttgtaatttctttaatctgttgttgcagtgtatctttttgtaaagtttgcaacaatcctcaatcaagtctatggaaaaattatttataaaatgtatttttaatcataagttgttcaaattaaaacttttctaaaatataaaagca

SEQ ID NO: 80219 - DNA, 821 bp, Homo sapiens
tgccacgacattccccagggtgcaggtgcccggtggccgagggtcagtccagtggtagagccttgctctcctaggctcatcctgctggcggtcctcctgcttctgctgtgtggtgtcacagctggttgtgtccggttctgctgcctccggaagcaggcacaggcccagccacatctgccaccagcacggcagccctgcgacgtggcagtcatccctatggacagtgacagccctgtacacagcactgtgacctcctacagctccgtgcagtacccactgggcatgcggttgcccctgccctttggggagctggacctggactccatggctcctcctgcctacagcctgtacaccccggagcctccaccctcctacgatgaagctgtcaagatggccaagcccagagaggaaggaccagcactctcccagaaacccagccctctccttggggcctcgggcctagagaccactccagtgccccaggagtcgggccccaatactcaactaccaccttgtagccctggtgccccttgaaggaggtaggagaacggaccagagcttggagaactaatgcttggagccaagggccccagcccaccccaccgtcccacacattgctgtggccccaacctcggtgccatgttacaccggcccctggcgtcacccactaggcaggctgctgctttcagcctcagcccctggcccagccccagcaggccctcagcctggaagaggccccttgggcctaagcctcgggtgggagctcagggccacctgtgacgtctgcatcttcttggagagagaataaagtttgtatttaa

SEQ ID NO: 80220 - DNA, 914 bp, Homo sapiens
gcccgggggccgctggccgcccgcggactgcggctgctgctgccgctcctgccgctcctgccgctcctgccgctgccgcaggtggcgctgggcttcgcggacggcagctgcgacccctcggaccagtgcccgccccaggcccgctggagcagcctgtggcacgtggggctcatcctgctggcggtcctcctgcttctgctgtgtggtgtcacagctggttgtgtccggttctgctgcctccggaagcaggcacaggcccagccacatctgccaccagcacggcagccctgcgacgtggcagtcatccctatggacagtgacagccctgtacacagcactgtgacctcctacagctccgtgcagtacccactgggcatgcggttgcccctgccctttggggagctggacctggactccatggctcctcctgcctacagcctgtacaccccggagcctccaccctcctacgatgaagctgtcaagatggccaagcccagagaggaaggaccagcactctcccagaaacccagccctctccttggggcctcgggcctagagaccactccagtgccccaggagtcgggccccaatactcaactaccaccttgtagccctggtgccccttgaaggaggtaggagaacggaccagagcttggagaactaatgcttggagccaagggccccagcccaccccaccgtcccacacattgctgtggccccaacctcggtgccatgttacaccggcccctggcgtcacccactaggcaggctgctgctttcagcctcagcccctggcccagccccagcaggccctcagcctggaagaggccccttgggcctaagcctcgggtgggagctcagggccacctgtgacgtctgcatcttcttggagagagaataaagtttgtatttaa

SEQ ID NO: 80221 - DNA, 529 bp, Homo sapiens
  misc_feature (345)..(345): n is a, c, g, or t
  misc_feature (370)..(370): n is a, c, g, or t
aaaaattaacttccatgaatcctactgggaatttgtttcataacaaaaatttcacaacgcactgtgctgacttccttgtgaaacgggttgtttctgagtgtgcagggaagtggcgggaggcttgggggtttgtcctggcttctgtacccctcagcgcccaaggcagggaagtggcgggaggctcggggggttgtcctggcttctgtacccctcagcgcccaaggcaggtgttgcaggaagcccgttcatgaggtgggtgtgggtggtgccagccaggtctggggacaccagcgtcagctgccccaggcctctgtgcaacccccacagtcgcacccttttgcggtnacccacattactgggcactcggganggctgttttctttcccaggagccctaaggacagatgccgcagggcttggagttgtaccccgtagcctctcagaggtccagaaaggtccaggcctcttccaatttttttgaggttcttcttctcttaaaaaataaaatggggaaattccataccagggtt

SEQ ID NO: 80222 - DNA, 4094 bp, Homo sapiens
cagagtgatgaggtcaaggggagaagctcactattaaatgtctacatttcaggagatgaagacaaagaaaaatgggcagaggagtatacattttacccggatcagagatagagacaaggcaagaaggcgcgttattagcattttaaaatttgcctctttcatttcttccttaatgtaagctggttcttttcacgacgaaacactccccccgcgctacacctctttttgcgcgaatctttctccaggaccttaaaatggtttactgagcacttcccgcgagccaagtatttggggttccagatcctgggattttgtcctgacactgcctcctcgttttaacacccttgcctccttctgcagtgccagtttccagggagctgaagcacaggaaaggcctgttctcgccactggccctgcccccatttgccggcgcccttcctcttcgcttccccgtagctcccgctttcgcctcttcgtttatgactccgttgggctccggccctcctagagaggcctccatagcgcaggttcgtgggttctcgcggacctttttccgtgtagctttctgcttcttcccggcattcctgtttccgttttctcacagccctctggcttttccaccactgagacactttgcgctcaggacttcagtgacgtcatctttctgcggcgcgcggacacccgccggtggaagaagaaacagctccgccgtccttcgcttcttttgctgggctgctgctccttcggcatcatggcgccgtcgctgtggaaggggctggtgggcatcggtctctttgccctagcccacgccgccttttccgctgcgcagcatcgttcttatatgcgattaacagaaaaagaagatgaatcactgccaatagatatagttcttcagacacttctggcctttgcagttacctgttacggtatagttcatattgcaggagagtttaaagacatggatgccacttcagaactgaaaaataagacatttgatacgttaaggaatcacccatccttttatgtatttaatcatcgtggtcgagtacttttccggccttcggatacagcaaattcttcaaaccaagatgcattgtcctctaacacatcattgaagttacgaaaactcgaatcactgcgtcgttaagatttttacaaattataataataggacaggacacagagctggaatattggagtttggggtataaaacactcctccctgcccccattagtatttatattgatctttcagacctactttagtaaaaaaaaccatggcccttgtttatatactgttaatccaatcattaatgcagtgtaagttatatgtgaaatgagtctttggtatttcatataggaattattttttttttcatttaaaacaaatccacatcttttgtaaaagccactgttttgaacacatttccttgaaaaatgttggtggtttttgtgattatttatttttttagatttcttttcttttgcactacaatttttggaatccttttggaaatactgtgtgactgctgtgttttgcagcatgaattatagtaaaatggtcttcaattcttaacaaatggacttccctgatgagaccaaaatggtgatttaacagtttttcttgtgtcccctaaaaagtggctctgcttcagaagtacttgccagtttttaatttatttgtgacttttcaccctaccctgctcccatataccttctaccatcagctgtcttgtttcatcatttctctgagattctgtgtgcagtgagcaatttttgtgtcagaaattctttgtcagaacaaatatatgtaacaggctcaacttactgtaaagctacttgtgttctcttcatttgtctgtaaaaatttccctaattgattatatagtgtaagaatagttgaagactagttgaagaccttttgtgatttcattatcatgcctatgcagaagaaaaatcattgaggaaaattgtcattagccagtttaactgattcaaactctgtttatttcatactaaactagtgaataagtgaaataaaggaaactcgtcattaatctaaagacagagttcaaaggaattgggccaaatatattctcagtatttggaactaatgtttttaaggtttttaggaaaatcaggtcatttaagaaattgttttgtagtttctggtttatagcagtcttcaagttttccatcttcactgtatgttgctgaaagtgaggatgaggatacagagttgatatttttagaaacagtaattttacttttaaggaaattggctagctctttgagctagagagctgtaggaagctcaacatttctttgtagagaacgttgctttttttggattgtacaggtataaaaacattgcttttgttgaattgtataggtgtaaaaagggaataactgtatgcaggtttgaaaaggaaatgtgctttaggcatgagtcataagatgccattgtacttgtaggcattttattttcctttagaaatggacatcagctcttctcttctgactggtaacacatagccccaaagcatgagattatttttcattgggtttttattgttgtttagttttggtttgttacgccagcccagtctgtctgcggaacactgactctgctctctaatgagaacaaagttagaaatctgccgataacctaaaataatttagaaatgaattaaaaatgtgaaatcgggttaaagtgatgatgataaaatagcatgcaagaaacaagctccttccatcagacttggctactgttttcttctggtacgatttggtttggaagagcctcttgtttccttctctttggggtatgtcttcgtttcttaatatgtttgtaacattattgagatataattcacataccttacaattcacttattttaagggtacaatttagtggtttttagtgtattcacaaagttgtgtaaccgtgaccacagtcaattttagaacatttcgttaccccaaaaagaaaccctgtacccttgagcagtcacctctcattttctcccagtgcccaccccatccccgagcccctggcaaccactaatctatttctctctctgtagatttgcttattctggtcatttcatataaatgggaattctacaatattcggtcttttgggactggcttcccaaatatgattttctatatggagtgagaaaattcttctcatcttgagaactcttattgctgtgaaagggagtggttggtaaaatcaatagatttcaggcaagagggccagatacctaacaggtttttctccgtgaatcttatgctgagtagtttttcctcataaccaagcatttatgatatattactacttataatactgtggctagtctctagaatggatgttgaaatctttgcctcctcagtcgggaagagtcctgctaaaaatcaggctaaaaatcaggccaaaaatcaggccaaatgacttggcaaataattgacaaagtggttttcacgtgtgtctatctttgctagcagcttgtatacctcaggccaggtgagctccccaaatttcttttttcatttactccagtgagtttctgctgtctttttcaagtatgtaccataggacttaaaggtgatttggatgcgttgtaacactgctaaatatgctaagtacagaattttatctacagtactgtgagacagtcaattattgcctagggtagttcaaaaatatgatgtgagctagttaagcctttgcttgactgatttcagtgatattcagaagtgtgtaccaatcaaggctctttaaaatacggaacgactcacttaataaccagggaaccagccaaatactgtgcagccgcagaatatgcatatcaatgagttggaggtgattattctctgtaactccctaatgattgttttctaagcattgtggcttctcagtggcttgacagcatcttcctggttgtatgtggcctgtttacatgatgtattgaataatgttgtttgttgtgagcatcaatgcctgtaacaccaaactaaacacgtgtttttgggatatgtttccaatctttaaatgaccttgccctgtccaataaataaatgattgtctc

SEQ ID NO: 80223 - DNA, 1080 bp, Homo sapiens
cagagtgatgaggtcaaggggagaagctcactattaaatgtctacatttcaggagatgaagacaaagaaaaatgggcagaggagtatacattttacccggatcagagatagagacaaggcaagaaggcgcgttattagcattttaaaatttgcctctttcatttcttccttaatgtaagctggttcttttcacgacgaaacactccccccgcgctacacctctttttgcgcgaatctttctccaggaccttaaaatggtttactgagcacttcccgcgagccaagtatttggggttccagatcctgggattttgtcctgacactgcctcctcgttttaacacccttgcctccttctgcagtgccagtttccagggagctgaagcacaggaaaggcctgttctcgccactggccctgcccccatttgccggcgcccttcctcttcgcttccccgtagctcccgctttcgcctcttcgtttatgactccgttgggctccggccctcctagagaggcctccatagcgcaggttcgtgggttctcgcggacctttttccgtgtagctttctgcttcttcccggcattcctgtttccgttttctcacagccctctggcttttccaccactgagacactttgcgctcaggacttcagtgacgtcatctttctgcggcgcgcggacacccgccggtggaagaagaaacagctccgccgtccttcgcttcttttgctgggctgctgctccttcggcatcatggcgccgtcgctgtggaaggggctggtgggcatcggtctctttgccctagcccacgccgccttttccgctgcgcagcatcgttcttatatgcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagggggtgaagaaattagaagaagtgggaagggaaaaaacgcc

SEQ ID NO: 80224 - DNA, 949 bp, Homo sapiens
tccttgcagattaattcttcctctaccccaacccagccggaagtctggtaatttccttacactttctcctctctttcaagtcccacatcttaaaagtgagctagtactgccagcttcctgaacatccttcaaacctgggccagctccatctcttctgttaccacgctgttgatgtatggtcaattcccaacagtccagccctggcagcttgcaacccagtctccaaactgtaactctggtgatccttttagaacacaagtcttacggtgccagttccttgctgataacctttttctggctttctatggcctatgtgctgaacccctagcacaatttacacagctctctgtgatctgacctagcagtctcctgtgtgcaccctaaggtccaataatacggcactgcagcatgcgccatgcctacccttgctgttcgtatcttcatgactttgcacacaccagcccccgctgcttggaaacctcctccttctctggtctgctgggctaccttctacatgtttctcagcgcaggcagcgctgcctccgcctaacccccaaggttaattgcccttctgtgtcctgtagcaccctgtccataatagcatagtagctgagaatacagactcctggatcagactgcctgggttctgacctgtttggtaaccttgatgaagtcagtgcctcaatttcctcacttgtaaaatggaggtaggaatgtctctacttcatagagttgtgaggattgaatggaatattgtatgtttaggtcttaaaccagtgctaggcacaagaatgctcaataaattaaagtgagttgcctgggtgcagtggctcatgcattaatcctagtactttgggaggcaaggcaggatgatcgcttgaggccaggggtttgcaactagcttgggcaacatagtgagaccccatcgctacaaaaatttaaaaaacta

SEQ ID NO: 80225 - DNA, 127 bp, Homo sapiens
tgacccccatgagggaggcaaggaagagagattggagggaagcacctagacttctatacagtttaaggaagtgtcacaaaagctgtcaagaactcctcaaaccaaagccatcagaaaagtctcttgt

SEQ ID NO: 80226 - DNA, 550 bp, Homo sapiens
gattcctcatggtcccacacattaggcagtattacattcagtggaaaaccaaaggtcgtggagataatgccagcaagtcctaacctatgcaagatgccttttctagacttggctatggactgataaggtgatcaccaagggaggggtgacaccaggactccacacatacctcatggatgtctaaggaataatggtttgaccatctttgcagtgttctccacttgccataggggtatttggagactaatctgccaacagtgagggctctctgctttttctgttgatgcaggtcctctgtgacattgtcacagcaacttgaaaatgagggatacgggtatgaactaactagatcctggctggtacaggcttccttatcctctgacagaatagcagtgctcctttgtgtctccatactttcctaccatgaccacaacaatccaggattgccatagatttgtccttgacctgcattaagttgaagagttggaagatagatagcacagtgccagcagaagcactaaagaaagaactaggtggtaacacaggctgg

SEQ ID NO: 80227 - DNA, 439 bp, Homo sapiens
tctttcctcttactttccttccttccctcctttcatatgagagactctatatggaaaaggaagctgaagtggcctgcacacgatatagaaaagccatattactttcctaagactggtaatccggcaatacctaatgcagcacatggctagagactccacatttgcccaacttctctgctcatcatttgccactgttctgtaaatttcccagtcccctcacagaaagcacatggcaccatttaaaatggctgctcactctctaagggaggtctcacaggctggtagtgagccctgtcccaatagtgaagttctccacaaatggggagacttctcccaggaggaggggaggcctggagatgggcatgcagtgggcaatgtcagctgccctccaggttctgctgccttttccgccctggtcagtatacaagcttcggggaca

SEQ ID NO: 80228 - DNA, 302 bp, Homo sapiens
tgatttaagccaacttgagactggggaatgccatcttagagaggtacagcgtgcagggctgtaaggaacttttatgatgacactctcgatcataacatctctcgttctttcaagcctgtcggcagctgagtttgagaatccgcccgagttctccacaccttttgaaagattggcactcccagataagaacatggaaagagctgttgtgtggaaaaggaggcagaaatttcctctgtacagccctagaattcagaactaggaccagtgaggcaaagtccaaggacacttttgcttggtatagg

SEQ ID NO: 80229 - DNA, 340 bp, Homo sapiens
gacaagaataacattggtttacatttttgcgaatctctctaatgacctggcttaatagaaacagctggattcttacatctacttctgcattcattccattgtagtattttattttttatatttaagtatatgaggaagttctaatttcatgcaaataagtggttggaaagagaggaatattttggctttttttttgtgagacagtctcactctgtcacccaggctggagtgcagtggtgcgatctcggctcacggcaacctccgcctcccggattcaagcaattctcgtgcctcggcctcccaagtagctgggattacaggtgtgcgccaccatgcccag

SEQ ID NO: 80230 - DNA, 3255 bp, Homo sapiens
tcgaaacagctgccggctggtcccggccgaggccggcgcagggagggaggagccgcccgggctgtgggggcgccgcgagctgggccggcctcggtgtgcccgcgccgccagcccgctccagacgcgccacctgggcgctccaagaagaggccgaagtttgccgcggccgtgagttggagctcgcgccgggccgctgcgccgggagctccgggggcttccctcgcttcccggtattgtttgcaaactttgctgctctccgccgcggcccccaactcggcggacgccgggcgcggagagccgagccgggggcgctgtgcgcagcgctcgggccaggccgggcgggcatgggcgggggcccgagcaggggtggagagccggggccagcagcagcccgtgcccgggagcggcggcgctgaggggcgcggagctccccgcgaggacacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttcttttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccgtaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactccggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatgatatttttcatgctccactattttattaaaaataaaatatgttctttagtttgctgcta

SEQ ID NO: 80231 - DNA, 862 bp, Homo sapiens
ctagtggttctcctgcctggggtgcagccctgtgtctgtatccagcctgtccctgctacttataggatgggctgtgggcgagttcctgcccctctgggcccctctgcaaggtggagagttggcaagttggctctgaagagcatttttgtcttcaagggcctcgttctgctcctctgggcctcagtaacccctgggtgctcctaagctgtaaagaaaaacaaaaagtgttccttatatgtcccaagaaaagaaacagtttctagtccccgcctcaagaagaaataaactatgtctaacccaagcacctccctgatcaggggcaaagaagcaaacttttcaagaaagaaacacccacaaaaaaacccccaccgatctgccaacccctcacccctgcctgcacatgcacacacacacgacacacatgcacacacagacacacatacatagagacacatacatacaacacagaggtacacatgcacatccccacactcaccaaatgcatgttctttgttaaaaggaagtaagtcctggagcctatcatggaattaaaggcagggttttgcagcttccaaattctgtaacctcagttgggtcacttggcagctctgtgcctctgtttccctatctgacagcaggtagagtttgagtaaatcagaaactagagaatctggatccagcctacaaacgtgttttatttggctcactcaggcctttgagacagcttgttgtcatgtaaagataggaagattccaggtaaaaatctaagatgcagcatgtcctaaagatatggtgtctgccacagcaaaatcagcaggcaatgagaagcaaccttgactccattagagctgcactctccagt

SEQ ID NO: 80232 - DNA, 260 bp, Homo sapiens
ttgcctcagcctcccgagtagctgggattataggcgcctgctaccatgcctggctaatttttgtatttttagtagagatggggttttgtcatgttggccaggctggtgtcaaactcctgacctcaggtgatccacccgcctcagcctcccaaagtgctgggattataggcttgagccaccgcgcccggccttatctgttatttcttatgtcttctacaaattgcatgtcttgtacttccttgtactagcagagcatagaa

SEQ ID NO: 80233 - DNA, 412 bp, Homo sapiens
aggtgaggccatataagccaactagcatttgacaagtagagtgtggaaaaagcaaacgattgtttggagactaatgttagtgtatctaggagtactagaatggaattgggggaaaaaattaagtagaaaatataccagaggacctaatactaaatccttagaagttttgcagagcatagagactctaattgtatattaaaaagcatctgcttacaaaagttacaaatatagatagtagttatttccttgtttcttttttcttaaaattctttataagaaccagataacgcatgttattttagattgacaggagtcctcctcttttcaatatttataccgtgtacagatattggattatgacatttctaggattttttggaagttagaagataccctattttttaaaatacca

SEQ ID NO: 80234 - DNA, 322 bp, Homo sapiens
tttttttgagatagagtttcactcttgttgcccaggctggaatgcaacggcacaatcttggctcactgcaacctccacctcccgggttcaagcgattctcctgcctcagccaactacccaattatctatgaacttagccatagcaatccccctgtgagcaggcacagtgattacaggctttcgctttaaaaccaaaaactccttggcccatcttttaccacaaggcacctcccgagtagctggggttacaggcgtctgccaccacgcccagctaattttttgtatttttagtagagacaaggtttcaccagattggtcaggc

SEQ ID NO: 80235 - DNA, 622 bp, Homo sapiens
tggagaggcagtgaaaaagcattaccttgtaggtttccaggcagcctggacaataggggcacctaaacccacattgaaaagccttcacatcatcacagctgagtctcatagccttcaactttaccagttttggagaacagagataaatgcactggccagaaactagaagagcagctgctccaattggctgggaaatcatttaactggctcctcatcttggctcttaaatccccaaaattgttgactgaggtttcccgggctcctttctatgctccacctccttgtgaccttaaggattctctgccactgtcctaacccctttcccgccttgcaacaatgaccagtctgtccctagctgtttggaaaattcccactgagtctgtgagcctctgttctggtaacctcgaccaccctgtcaccagtatctctggtccaccagtgcggtgtaactcaagggagcagcatctctccagattgctgaagtgagggagggagattatgagggaactgccccaaggacacaaggattcattcttagagttcccacatcttgattaaaataaacagtacaggaaatagactgcaggcacatccaggtgattaaaaaatttaacaccaggca

SEQ ID NO: 80236 - DNA, 473 bp, Homo sapiens
  misc_feature (11)..(11): n is a, c, g, or t
cgccttgctgntgaatcctagcactttatgaggccgaggagggtggattagttgaggccaggagttcgagaccagcttgggaaacatggcgaaaccccatttctactaaaaattcaaaaatcagccaagcatggtgcgtgagccaccacttctggccacaaatttctttttgaaggcttattccagttttgtgaggctagcatgaggtgtatgcatttgccaggggcaaatttatactgctgaattaacccatgcaacaaatgctgcacatctgctcgcagtccatttagaggcatttgcggtagacaatggaggggccagactcatcatacatacctgatggctaacccacatgcttgcagtccatttagagggcatttgcagtggatgatggaggggccacatacctaattgctaatccacatctgctggaaggtggacagtgaggccaggatggaaccaccaatccacac

SEQ ID NO: 80237 - DNA, 3271 bp, Homo sapiens
  misc_feature (1517)..(1517): n is a, c, g, or t
ctaaattacccactacgttgcttgtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctggagctgctcaagtttgatcggaagcaacttcgatcagttttgaataatttaaagggagacaagtttatcaaatgcagaatgagggtagagactgctgcagacgggaaaaccactcgccataactactacttcatcaattatcgtactcttgttaatgtggtaaaatataaactggaccacatgagaagaagaattgagaccgatgagagagattcgaccaaccgggcttccttcaaatgtcctgtctgtagtagtactttcacagacttagaagctaatcagctctttgatcctatgacaggaactttccgctgtactttttgccatacagaggtagaagaggatgaatcagcaatgcccaaaaaagatgcacgcacacttttggcaaggtttaatgaacaaattgagcccatttatgcattgcttcgggagacagaggatgtgaacttggcctatgaaatacttgagccagaacccacagaaatcccagccctgaaacagagcaaggaccatgcagcaactactgctggagctgctagcctagcaggtgggcaccaccgggaagcatgggccaccaaaggtccttcctatgaagacttatacactcagaatgttgtcattaacatggatgaccaagaagatcttcatcgagcctcactggaagggaaatctgccaaagagaggcctatttggttgagagaaagcactgtccaaggggcatatggttctgaagatatgaaagaagggggcatagatatggacgcatttcaggagcgtgaggaaggccatgctgggcctgatgacaacgaagaggtcatgcgagcactgctcattcacgagaaaaagacttcctctgccatggctggttcagtgggggcagctgctccagtgaccgctgccaatggcagtgactcagaaagcgagaccagtgagtcagatgatgattctccaccccgtccggcagctgtggctgtgcataaacgagaagaggatgaagaggaagatgacgagtttgaagaagtagcagatgaccccattgtcatggtggctggccgtccgttctcctacagtgaagtgagccaacggccagagctagtggcccagatgacaccagaagaaaaggaagcatatatagcaatgggacaacgcatgtttgaggacctctttgagtgagctttccctaattctttctcctttctctaatgctcagttcaaaaaggaatgtctcatctttgaagaaaagtatttaagtggctttctgcccctcttgatgtaagcaactgtccatccttgtgcaaagattgatggtagagagnttgacttttatgccagaaactttcccagcaaggtagggtgctgagaatcctacccttccttgctgtcactacagtattaatattttactgtattttcttttcttttttttttttttttggagatgaagtctcactcttgtaccccaggctggagtgcaatggcgtgatctcggctcactgcaacctctgcctcctgggttcaagcgattctcctgcctcagcctcccgagtagctgggattacaggtgcctgccaccatgcctggctaatttttgtatttttagtagaggcagggtttcaccatgttagccaggatgatctcgatctcctgacctcatgatccacccgcctcggcctcccaaagtgctgtattttcttatctgatttttttcttgccttattaagacataattttctcccttctgaaatgagtgagggaagttcataaggtaaatccttcccatccatctgtttactacaataggttacaataattcactgatcacatccattttatctgttctagccaggcattccaaacaatttcttatactgctgcccaccaaagcagcttgccaacagtcaaatcactgattgggggaaaaaatcctgaaattttgcttagaatttgagcatttcctcaaaattgagatggatcaatatgtaaggggaggtgggagcgtgtgtggaagggggagagatatacttgagtcttatgattaatgtctaaaccagaatttgtgtctttagaactgaccagactggtagattttattgtattgcttaatgtcttttggtttggatttaggatgatagaaaacagaagtataattggtaaacccttaggaagaaattagaaaaacatggacgtaagacaagaagtctctgtgaagggttgaagagtgacaagcattggtaacagtgccttagaactgtgtcagttagtctgatttggaaatcctttatgtaaagctgagactggtcctggttttgttccctttgggtacagacctcttgtcagtgctataaattgtttaatgaggccattccagcagaaatcaacagaataattgattactcttctctctctctgtcactctccctctttctaaacatcattgaaggctgtctctcttttaatttttgtcagacacagtattttagggtgcatccagtataccattgagcattgtaacctcaggaaacagtttattttgggttctgatatgtagcatggtattttccctaaggcagaactttaaaaataaagaactttcacacaagggtctgtaacaattgtatatcttacaatatttttccttgcattgtaatttttaagtatttatcattttatagtacacatgtaaagaatatatgagccttgtatggagtgatgtttcatttacctgggttgtgttaatgactgaatgttgacaataaatctgttttatactgactgaagtttgttcattttaagttctgtaacatcttggggcatattaaaatgaatattcttcccattaaaaaaatgttaaagacttttttattagtcatatttcaaatgatagatgcatatgggatctaaactttttgtgcaataagatgcctttgtaccttgtatacgtaaagtattcaacttttacacttgatcttagccaaaagaccaagaagcaatgctcttcagcttttaaacattgttttttaaacttttatagttctagaagttaatttaaataaaatggtaatcagatgtt

SEQ ID NO: 80238 - DNA, 589 bp, Homo sapiens
agttgaagcgctgggggcagctgtagtgggagtgttccaggattcgccttgtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctggagctgctcaagtttgatcggaagcaacttcgatcagttttgaataatttaaagggagacaagtttatcaaatgcagaatgagggtagagactgctgcagacgggaaaaccactcgccataactactacttcatcaattatcgtactcttgttaatgtggtaaaatataaactggaccacatgagaagaagaattgagaccgatgagagagattcgaccaaccgggcttccttcaaatgtcctgtctgtagtagtactttcacagacttagaagctaatcagctctttgatcctatgacaggtgaggtttatccagtttgtgaatctttaaaataaagtgtgtattaccttttttcttaaa

SEQ ID NO: 80239 - DNA, 624 bp, Homo sapiens
atcatgaacactagtgtcatgtatacagaacactagtgcatccagtataccattgagcattgtaacctcaggaaacagtttattttgggttctgatatgtagcatggtattttccctaaggcagaactttaaaaataaagaactttcacacaagggtctgtaacaattgtatatcttacaatatttttccttgcattgtaatttttaagtatttatcattttatagtacacatgtaaagaatatatgagccttgtatggagtgatgtttcatttacctgggttgtgttaatgactgaatgttgacaataaatctgttttatactgactgaagtttgttcattttaagttctgtaacatcttggggcatattaaaatgaatattcttcccattaaaaaaatgttaaagacttttttattagtcatatttcaaatgatagatgcatatgggatctaaactttttgtgcaataagatgcctttgtaccttgtatacgtaaagtattcaacttttacacttgatcttagccaaaagaccaagaagcaatgctcttcagcttttaaacattgttttttaaacttttatagttctagaagttaatttaaataaaatggtaatcagatgtt

SEQ ID NO: 80240 - DNA, 591 bp, Homo sapiens
gagctgtagagccaagctgttcgaggatccgcctcgttatattaaaagtggtgttcgtaagctgtatcatgagagaaaccatgatgtcctcatagaggttgcatatcatcgatgcggttagccaggtgatgtgactccgggtattgaatggattctgaatgtgcttctgacgttgagacactgtttgtactcatcgaacttcctcctgtgtgaaagaggaggatatgctggagctgctcaagtttgatcggaagcaacttcgatcagttttgaataatttaaagggagacaagtttatcaaatgcagaatgagggtagagactgctgcagacgggaaaaccactcgccataactactacttcatcaattatcgtactcttgttaatgtggtaaaatataaactggaccacatgagaagaagaattgagaccgatgagagagattcgaccaaccgggcttccttcaaatgtcctgtctgtagtagtactttcacagacttagaagctaatcagctctttgatcctatgacaggtgaggtttatccagtttgtgaatctttaaaataaagtgtgtattaccttttttcttaaa

SEQ ID NO: 80241 - DNA, 3298 bp, Homo sapiens
  misc_feature (1544)..(1544): n is a, c, g, or t
agttgaagcgctgggggcagctgtagtgggagtgttccaggattcgccttgtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctggagctgctcaagtttgatcggaagcaacttcgatcagttttgaataatttaaagggagacaagtttatcaaatgcagaatgagggtagagactgctgcagacgggaaaaccactcgccataactactacttcatcaattatcgtactcttgttaatgtggtaaaatataaactggaccacatgagaagaagaattgagaccgatgagagagattcgaccaaccgggcttccttcaaatgtcctgtctgtagtagtactttcacagacttagaagctaatcagctctttgatcctatgacaggaactttccgctgtactttttgccatacagaggtagaagaggatgaatcagcaatgcccaaaaaagatgcacgcacacttttggcaaggtttaatgaacaaattgagcccatttatgcattgcttcgggagacagaggatgtgaacttggcctatgaaatacttgagccagaacccacagaaatcccagccctgaaacagagcaaggaccatgcagcaactactgctggagctgctagcctagcaggtgggcaccaccgggaagcatgggccaccaaaggtccttcctatgaagacttatacactcagaatgttgtcattaacatggatgaccaagaagatcttcatcgagcctcactggaagggaaatctgccaaagagaggcctatttggttgagagaaagcactgtccaaggggcatatggttctgaagatatgaaagaagggggcatagatatggacgcatttcaggagcgtgaggaaggccatgctgggcctgatgacaacgaagaggtcatgcgagcactgctcattcacgagaaaaagacttcctctgccatggctggttcagtgggggcagctgctccagtgaccgctgccaatggcagtgactcagaaagcgagaccagtgagtcagatgatgattctccaccccgtccggcagctgtggctgtgcataaacgagaagaggatgaagaggaagatgacgagtttgaagaagtagcagatgaccccattgtcatggtggctggccgtccgttctcctacagtgaagtgagccaacggccagagctagtggcccagatgacaccagaagaaaaggaagcatatatagcaatgggacaacgcatgtttgaggacctctttgagtgagctttccctaattctttctcctttctctaatgctcagttcaaaaaggaatgtctcatctttgaagaaaagtatttaagtggctttctgcccctcttgatgtaagcaactgtccatccttgtgcaaagattgatggtagagagnttgacttttatgccagaaactttcccagcaaggtagggtgctgagaatcctacccttccttgctgtcactacagtattaatattttactgtattttcttttcttttttttttttttttggagatgaagtctcactcttgtaccccaggctggagtgcaatggcgtgatctcggctcactgcaacctctgcctcctgggttcaagcgattctcctgcctcagcctcccgagtagctgggattacaggtgcctgccaccatgcctggctaatttttgtatttttagtagaggcagggtttcaccatgttagccaggatgatctcgatctcctgacctcatgatccacccgcctcggcctcccaaagtgctgtattttcttatctgatttttttcttgccttattaagacataattttctcccttctgaaatgagtgagggaagttcataaggtaaatccttcccatccatctgtttactacaataggttacaataattcactgatcacatccattttatctgttctagccaggcattccaaacaatttcttatactgctgcccaccaaagcagcttgccaacagtcaaatcactgattgggggaaaaaatcctgaaattttgcttagaatttgagcatttcctcaaaattgagatggatcaatatgtaaggggaggtgggagcgtgtgtggaagggggagagatatacttgagtcttatgattaatgtctaaaccagaatttgtgtctttagaactgaccagactggtagattttattgtattgcttaatgtcttttggtttggatttaggatgatagaaaacagaagtataattggtaaacccttaggaagaaattagaaaaacatggacgtaagacaagaagtctctgtgaagggttgaagagtgacaagcattggtaacagtgccttagaactgtgtcagttagtctgatttggaaatcctttatgtaaagctgagactggtcctggttttgttccctttgggtacagacctcttgtcagtgctataaattgtttaatgaggccattccagcagaaatcaacagaataattgattactcttctctctctctgtcactctccctctttctaaacatcattgaaggctgtctctcttttaatttttgtcagacacagtattttagggtgcatccagtataccattgagcattgtaacctcaggaaacagtttattttgggttctgatatgtagcatggtattttccctaaggcagaactttaaaaataaagaactttcacacaagggtctgtaacaattgtatatcttacaatatttttccttgcattgtaatttttaagtatttatcattttatagtacacatgtaaagaatatatgagccttgtatggagtgatgtttcatttacctgggttgtgttaatgactgaatgttgacaataaatctgttttatactgactgaagtttgttcattttaagttctgtaacatcttggggcatattaaaatgaatattcttcccattaaaaaaatgttaaagacttttttattagtcatatttcaaatgatagatgcatatgggatctaaactttttgtgcaataagatgcctttgtaccttgtatacgtaaagtattcaacttttacacttgatcttagccaaaagaccaagaagcaatgctcttcagcttttaaacattgttttttaaacttttatagttctagaagttaatttaaataaaatggtaatcagatgtt

SEQ ID NO: 80242 - DNA, 1246 bp, Homo sapiens
agttgaagcgctgggggcagctgtagtgggagtgttccaggattcgccttgtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctggagctgctcaagtttgatcggaagcaacttcgatcagttttgaataatttaaagggagacaagtttatcaaatgcagaatgagggtagagactgctgcagacgggaaaaccactcgccataactactacttcatcaattatcgtactcttgttaatgtggtaaaatataaactggaccacatgagaagaagaattgagaccgatgagagagattcgaccaaccgggcttccttcaaatgtcctgtctgtagtagtactttcacagacttagaagctaatcagctctttgatcctatgacaggaactttccgctgtactttttgccatacagaggtagaagaggatgaatcagcaatgcccaaaaaagatgcacgcacacttttggcaaggtttaatgaacaaattgagcccatttatgcattgcttcgggtgcatccagtataccattgagcattgtaacctcaggaaacagtttattttgggttctgatatgtagcatggtattttccctaaggcagaactttaaaaataaagaactttcacacaagggtctgtaacaattgtatatcttacaatatttttccttgcattgtaatttttaagtatttatcattttatagtacacatgtaaagaatatatgagccttgtatggagtgatgtttcatttacctgggttgtgttaatgactgaatgttgacaataaatctgttttatactgactgaagtttgttcattttaagttctgtaacatcttggggcatattaaaatgaatattcttcccattaaaaaaatgttaaagacttttttattagtcatatttcaaatgatagatgcatatgggatctaaactttttgtgcaataagatgcctttgtaccttgtatacgtaaagtattcaacttttacacttgatcttagccaaaagaccaagaagcaatgctcttcagcttttaaacattgttttttaaacttttatagttctagaagttaatttaaataaaatggtaatcagatgtt

SEQ ID NO: 80243 - DNA, 865 bp, Homo sapiens
agttgaagcgctgggggcagctgtagtgggagtgttccaggattcgccttgtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctggagctgctcaagtttgatcggaagcaacttcgatcagttttgaataatttaaagggagacaagtttatcaaatgcagaatgagggtagagactgctgcagacgggaaaaccactcgccataactactacttcatcaattatcgtactcttgttaatgtggtaaaatataaactggaccacatgagaagaagaattgagaccgatgagagagattcgaccaaccgggcttccttcaaatgtcctgtctgtagtagtactttcacagacttagaagctaatcagctctttgatcctatgacaggaactttccgctgtactttttgccatacagaggtagaagaggatgaatcagcaatgcccaaaaaagatgcacgcacacttttggcaaggtttaatgaacaaattgagcccatttatgcattgcttcgggagacagaggatgtgaacttggcctatgaaatacttgagccagaacccacagaaatcccagccctgaaacagagcaaggacctttggtggcccatgcttcccggtggtgcccacctgctaggctagcagctccagcagtagttgctgcatggtccttgctctgtttcagggctgggatttctgtgggttctggctcaagtatttcata

SEQ ID NO: 80244 - DNA, 208 bp, Homo sapiens
  misc_feature (52)..(52): n is a, c, g, or t
  misc_feature (54)..(54): n is a, c, g, or t
cgtgtgcagcctatcaagctggccagggtcaccaaggtcctgggcaggacgntntctcagggacagtgcacgcaggtcgcgtggaattcatggacgacacgagccgatccatcatccgcaatgtaaaaggccccgtgcgcgagggcgacgtgctcacccttttggagtcagagcgagaagcccggaggttgcgctgagcttgcttgct

SEQ ID NO: 80245 - DNA, 232 bp, Homo sapiens
  misc_feature (33)..(33): n is a, c, g, or t
  misc_feature (66)..(67): n is a, c, g, or t
acaccagcgtgtcagctatagctggccaggggntcacccaaagggttccctgtggcagtgaccggnnttcttcagggaaccagtgtgcacgccaggggtgccgcgtggaattcatggacgacacgagccgatccatcatccgcaatgtaaaaggccccgtgcgcgagggcgacgtgctcacccttttggagtcagagcgagaagcccggaggttgcgctgagcttgcttgct

SEQ ID NO: 80246 - DNA, 741 bp, Homo sapiens
ctaatttacattttcatcaacagtgtacgagggttctccgttttctgcactcttgccagcatccgttttttcctgtcttttgataaaaaccactttaactgggggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacacatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcacgtgagtctctccaaatgatggacatcccagatccccaaagggcagcagtgcagtagccatagacagtgcccagcaacctaagaaggagcgagccttccgggacaatgaacaaaactggccctaattacttaggtaatttttgcagctgtagcagataaat

SEQ ID NO: 80247 - DNA, 478 bp, Homo sapiens
gggccaaggctctgtcttctggcttgaaatctggggaatcatctccctatccctgcctttgggtctccataacaggaggcagcaattcctcctgccactggttaaatatttatttgaagattctatttcaggaaatgtggactgcaagatcaagagagagaggaaatactttatttcgagccactctccttgcagtctcagactgggttccaatcttgctgtgccaagaataaagtcaacttcatatttatatagttatattatccggagatctgagaaagaatggacgttacactgatcttctatgttcttttatttagtttctaacttcaatgttatttatatctaagtctgaatgctgtctatattgaaaatagttaatttattaaaacattttttcacgtaagtttatggtcacagtacctaatctttgctaaatgtttgatttatttctaaaaagtcttaaaatgatagttta

SEQ ID NO: 80248 - DNA, 596 bp, Homo sapiens
tcatggttcaaaatatcctcaatttcaaggactattgcagagtacactgaatttcatatgctgatgtatgtattgtgactactatacaaattctgttaaaagaaacaaatgattcaattttattaaattatacataacatagctattaggtgacagtattaagtttttctaagtttttattttttttttcattgaagagaataattgccattcccatttcccacctccaccaaccaaataatgtatcactggctcttcacaaagttatgacttgggaaaatgctgaaggaatggtaatataagataaagtgggctaggcatggtggctcacacctgtaatcccagaactttgagaagccaaggtgggtggatcacctgaggtcaggagctcaagaccagcctggacaacatgatgaaaccccatctctacaaaactacaaaaattagctaggcatgatggctggtacctgtaatcccagttgctcaggaggctgaggggggagaatcacttgaacctggaaggcggaggttgccttgagccaagattgcaccattgcactccagcctgggtgacagagcaagactccatatcaatt

SEQ ID NO: 80249 - DNA, 633 bp, Homo sapiens
gccagtaggaacgtttcttttcacctcgttgcattacccaccttcttcattttctcctttataaactgtcttccgcccaggggccgctgagccctctgttcctgttctgcgaaccgtcctttggaggaaaggaacaggctgctggggaggggaagactcagaatttctagttcccagcaaagcctccaggcaggcagtatcgatgcgctctctccgaaattgataaaatagcgagcaggcctcataccctcagctgggcacttatgaatatccccagcgtttcgagctgtcgagctctgcgtggaaagaattggtttctaagaatatagtcgaaaatttggggccgggcgcggtggctgacgcctgtaatcccagcactttgggaggctgatgtgggcggatcacctgaggtcagaagttcgagaccatcctggccaacatggcgaaaacccatctatactaaaaatacaaaaattagccggcgtggtggcgcgtgcctgtaatcccagctactcgggaggctgaggcaggagaatgacttgaactcgggaggcggaggttgcagtgagccgatatcgctccattgctctccagcctgggcgacagagtgagacttcgtctcagaaaaaaaaa

SEQ ID NO: 80250 - DNA, 258 bp, Homo sapiens
ggatttactccacagcagctccctgggtgcagagatcttggtgcagatcccatttcgctgacttgctttctctccttagacaaatgtgtgtggcggggctgagtacctgctcatgtccttttctggggacgccacacatggctggtttctggcccttggggacagtggctcaggtccagaggagaacccttactggctgtagtgtggtgggcacagcaggggtgggccggttcacctcctggctttgaagaaatgggt

SEQ ID NO: 80251 - DNA, 410 bp, Homo sapiens
atgagctcttatttcgtcaactcactgttctccaaatacaaaaccggggagtccctgcgccccaattattatgactgcggcttcgcccaggacctgggcggccgacccaccgtggtgtacggtcccagcagcggcggcagcttccagcacccgtcgcaaatccaggagttctaccacgggccgtcgtcgctgtccacggctccctaccagcagaacccgtgcgccgtggcgtgccacggggaccccggcaatttctacggctacgacccgctgcaacgccagagcctattcggtgcgcaggatccagacctggattcgcgaccgacctggattcgcgaccgacctggattcgcgaccgacctggattcgcgaccgacctggattcgcgaccgacctggattcgcgaccga

SEQ ID NO: 80252 - DNA, 1588 bp, Homo sapiens
atgagctcttatttcgtcaactcactgttctccaaatacaaaaccggggagtccctgcgccccaattattatgactgcggcttcgcccaggacctgggcggccgacccaccgtggtgtacggtcccagcagcggcggcagcttccagcacccgtcgcaaatccaggagttctaccacgggccgtcgtcgctgtccacggctccctaccagcagaacccgtgcgccgtggcgtgccacggggaccccggcaatttctacggctacgacccgctgcaacgccagagcctattcggtgcgcaggatccagacctggtgcagtacgcagactgcaagcttgccgccgccagcggcctgggcgaggaggccgagggctccgagcagagcccgtcgcccacacagctcttcccctggatgcgcccgcaagcagccgccggacgcaggcgaggccgacagacctacagccgctaccagaccctggagctggagaaggagttcctatttaatccctatctgactcgtaagcggcgaatcgaggtatcgcacgccctgggactgacagagagacaggtcaaaatctggttccagaaccggaggatgaagtggaaaaaagagaacaacaaagacaagttccccagcagcaaatgcgagcaggaggagctggagaaacagaagctggagcgggccccagaggcggcggacgagggcgacgcgcagaagggcgacaagaagtaggcttcagctgggactgccagggccgcggccgcccgcacgtccgcgggtcccggccgcgccgccgccgcgcgcccctgcccgagagagctctggccccgctagcggggccaggagccgggcctcccaccgcagcgtcccccgccgcgccagtccccgctagtggtagtatctcgtaatagcttctgtgtgtgagctaccgtggatctccttcccttctcttgggggccggggggaaagaaaaggatttaagcaaaggctccctcgccctgtgagggcgagcggcaaaggcccggctgagccccccatgcccctcccctccccgtgtaaaaagcctccttgtgcaattgtcttttttttcctttgaacgtgcttctttgtaatgaccaaggtaccgatttctgctaagttctcccaacaacatgaaactgcctattcacgccgtaattctttctgtctcccttctctctctctctctcgctcgctcgctctcgctctcgctctctctcgctgcgtcctcatttcccctcccaatcctctctcccctctgcaaccccccagctcgctggctttctctctggcttctctcttttcctcctccacccaccccctttggtttgacaattttgtcttaagtgtttctcaaaagaggttactttagttagcatgcgcgctgtgggcaattgttacaagtgttcttaggtttactgtgaagagaatgtattctgtatccgtgaattgctttatgggggggagggagggctaattatatattttgttgttcctctatactttgttctgttgtctgcgcctgaaaagggcggaagagttacaataaagtttacaagcgagaacccga

SEQ ID NO: 80253 - DNA, 1212 bp, Homo sapiens
taggatgcggggtctctaatggatgcaaatgatcatgaaaagacagtgcaaaatatgaaacaactcatttgcagggaagtaaatcaccgaaaactgtttatgaactggcatcccttttcctatttaatccctatctgactcgtaagcggcgaatcgaggtatcgcacgccctgggactgacagagagacaggtcaaaatctggttccagaaccggaggatgaagtggaaaaaagagaacaacaaagacaagttccccagcagcaaatgcgagcaggaggagctggagaaacagaagctggagcgggccccagaggcggcggacgagggcgacgcgcagaagggcgacaagaagtaggcttcagctgggactgccagggccgcggccgcccgcacgtccgcgggtcccggccgcgccgccgccgcgcgcccctgcccgagagagctctggccccgctagcggggccaggagccgggcctcccaccgcagcgtcccccgccgcgccagtccccgctagtggtagtatctcgtaatagcttctgtgtgtgagctaccgtggatctccttcccttctcttgggggccggggggaaagaaaaggatttaagcaaaggctccctcgccctgtgagggcgagcggcaaaggcccggctgagccccccatgcccctcccctccccgtgtaaaaagcctccttgtgcaattgtcttttttttcctttgaacgtgcttctttgtaatgaccaaggtaccgatttctgctaagttctcccaacaacatgaaactgcctattcacgccgtaattctttctgtctcccttctctctctctctctcgctcgctcgctctcgctctcgctctctctcgctgcgtcctcatttcccctcccaatcctctctcccctctgcaaccccccagctcgctggctttctctctggcttctctcttttcctcctccacccaccccctttggtttgacaattttgtcttaagtgtttctcaaaagaggttactttagttagcatgcgcgctgtgggcaattgttacaagtgttcttaggtttactgtgaagagaatgtattctgtatccgtgaattgctttatgggggggagggagggctaattatatattttgttgttcctctatactttgttctgttgtctgcgcctgaaaagggcggaagagttacaataaagtttacaagcgagaacccga

SEQ ID NO: 80254 - DNA, 1249 bp, Homo sapiens
atgagctcttatttcgtcaactcactgttctccaaatacaaaaccggggagtccctgcgccccaattattatgactgcggcttcgcccaggacctgggcggccgacccaccgtggtgtacggtcccagcagcggcggcagcttccagcacccgtcgcaaatccaggagttctaccacgggccgtcgtcgctgtccacggctccctaccagcagaacccgtgcgccgtggcgtgccacggggaccccggcaatttctacggctacgacccgctgcaacgccagagcctattcggtgcgcaggatccagacctggtgcagtacgcagactgcaagcttgccgccgccagcggcctgggcgaggaggccgagggctccgagcagagcccgtcgcccacacagctcttcccctggatgcgcccgcaagcagccgccggacgcaggcgaggccgacagacctacagccgctaccagaccctggagctggagaaggagttcctatttaatccctatctgactcgtaagcggcgaatcgaggtatcgcacgccctgggactgacagagagacaggtcaaaatctggttccagaaccggaggatgaagtggaaaaaagagaacaacaaagacaagttccccagcagcaaatgcgagcaggaggagctggagaaacagaagctggagcgggccccagaggcggcggacgagggcgacgcgcagaagggcgacaagaaaaacggcagcgtccaaggcccgtgggctggatcctgtgccctaggagcacctaggaagacttgctccatctccgcccgcatatctggggcaccaagagagacagagtcgtgagccaggctcgcctcattcctcgtcttgggagaaccggaccaacttccccaaaaggccttgccgtgcagaattggcctggtttaataaagaacagacctgccccaagcacccacccacccagttgcgtgcattcaatccctgcgtttgtctctcgctcggtaacgggctgaagaggatgggtggagggtgacacggatcgccccgaggttatttattttcccttccactcaatctcttcctccccaaatctcgcctgcaagcggcctccagcccgcgggagtcggcagcggcccttgagcccccagccccaatccacagggctcggctttcccattcattattgatcatattttataaatccaacgccacacaattttttccacattaccgggagccgtggggagacggc

SEQ ID NO: 80255 - DNA, 964 bp, Homo sapiens
atgagctcttatttcgtcaactcactgttctccaaatacaaaaccggggagtccctgcgccccaattattatgactgcggcttcgcccaggacctgggcggccgacccaccgtggtgtacggtcccagcagcggcggcagcttccagcacccgtcgcaaatccaggagttctaccacgggccgtcgtcgctgtccacggctccctaccagcagaacccgtgcgccgtggcgtgccacggggaccccggcaatttctacggctacgacccgctgcaacgccagagcctattcggtgcgcaggatccagacctggtgcagtacgcagactgcaagcttgccgccgccagcggcctgggcgaggaggccgagggctccgagcagagcccgtcgcccacacagctcttcccctggatgcgcccgcaagcagccgccggacgcaggcgaggccgacagacctacagccgctaccagaccctggagctggagaaggagttcctatttaatccctatctgactcgtaagcggcgaatcgaggtatcgcacgccctgggactgacagagagacaggtcaaaatctggttccagaaccggaggatgaagtggaaaaaagagaacaacaaagacaatttcccctcccaatcctctctcccctctgcaaccccccagctcgctggctttctctctggcttctctcttttcctcctccacccaccccctttggtttgacaattttgtcttaagtgtttctcaaaagaggttactttagttagcatgcgcgctgtgggcaattgttacaagtgttcttaggtttactgtgaagagaatgtattctgtatccgtgaattgctttatgggggggagggagggctaattatatattttgttgttcctctatactttgttctgttgtctgcgcctgaaaagggcggaagagttacaataaagtttacaagcgagaacccga

SEQ ID NO: 80256 - DNA, 405 bp, Homo sapiens
cttccaaacagatacagtcagtttatatacactaatagatacagtgctccccacctcaaaaaaaatagacgaagctattttgaagatgatcccctgaggagctggcatgacttagagcccatagttgccctgtgctacttccatgatgttaaatttcaaagcagagattacattttaattataatagcatgctttagagggattcacagcttaaaaaaacaactggaagcaaattgtacatgcaagtgattaaatgtcttatccatgtgatttccattctcaaagcttgatttataacacttggattcctaaaatctgttcttgcctttttctttccaccatattatgagttatctcagactgctcatgataaatgaggtgactaccactgatttttacaatgac

SEQ ID NO: 80257 - DNA, 331 bp, Homo sapiens
aattttaaaaattatctaggcgtgatggtgcctttggtcccagctccttgggaggccgacgggaaaagatcgattgagcctgggaggttaaggctgcagtgagctatggttgtgccactgttttccagcctgggtgatgaagcaagaccctgtctctcaaaaaaagcaaaaggtaaaactggatacccaccaaaattcccactaaaggggactgttttaaattaattatgtcaaggcgcctcacaagagaatatgctgcagccatgaaaactaaagacaagagtctctagttactcatatgttaagatgcctatggcatgctattggggga

SEQ ID NO: 80258 - DNA, 1157 bp, Homo sapiens
agttctgcaggttttacaggaagcatggtgctggcatctccttggtttctagggaagcctcaggaagcttacaatcatgacaaggcaaaggaggagcgatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgaatttaattctttcacaaaaatgatttcaaattatcctagagtataacatttttatcaaag

SEQ ID NO: 80259 - DNA, 765 bp, Homo sapiens
agttctgcaggttttacaggaagcatggtgctggcatctccttggtttctagggaagcctcaggaagcttacaatcatgacaaggcaaaggaggagcgatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattactt

SEQ ID NO: 80260 - DNA, 847 bp, Homo sapiens
  misc_feature (779)..(779): n is a, c, g, or t
  misc_feature (785)..(785): n is a, c, g, or t
  misc_feature (824)..(824): n is a, c, g, or t
tgtctagatttttcttggcctttctgagtacgtattcctttcttctgagtgtggtgaggaccctctctggaaagggaatcttattacctacagttaaacaaggatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattacttaaaaaaatncggctngttggcctcagcgggggactttgcggcccttcccttcantgaggctaataatcaccatggtc

SEQ ID NO: 80261 - DNA, 516 bp, Homo sapiens
caaacacacttgtctgccccccgcactcatggaatatgaattttctgtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattactt

SEQ ID NO: 80262 - DNA, 727 bp, Homo sapiens
  misc_feature (373)..(373): n is a, c, g, or t
  misc_feature (379)..(379): n is a, c, g, or t
cggcccaggacatccccaagtcgcccaatttcaacggctcacccgactcccaaccgttactcaccccagagaggcgttctgcatcctttcgcgtactacgccggccgagaggtagagtaatttaataggcgctcgcaggccatatcagctcgctgtaagaccgtgcgacgcatctctcccgctgaaaccaacaaggttaaagtgtccgcggaaccgaaccgcccctccccgagtcgaccctatatcctaaggtacgttgataggaccagagaaccgtcggcgagtggtactggcaagaagcaagttcatttgacactaaaattattcaacaccccccccagaaaaaagccaaccttaaaaccacaaataacanaaaaanaaaaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattactt

SEQ ID NO: 80263 - DNA, 1527 bp, Homo sapiens
agcggatggaaatctgctgtgcatccagagagcaaagtgggatgatctgtcactacacctgcagcaccacgctcggaggacagctcctgcctgcagcttccagacccaggaagcctgaggggaaggaaggaagtacgggcgaaatcatcagattggcttcccagatttgggaatctgaagcgggcccacatcttccggccaacttccattgaacttcccagcactcgaaagggaccgaaatggagagcaaagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgaatttaattctttcacaaaaatgatttcaaattatcctagagtataacatttttatcaaag

SEQ ID NO: 80264 - DNA, 2110 bp, Homo sapiens
  misc_feature (293)..(293): n is a, c, g, or t
ctaatcttcagaaccgcgggccgcagggagttaaattgctgccttcctctccttctctcgtgcggttggtggcttgttttctaaaggaacgttttattcactttttagtattttctaccgggggcgcgctacccgcctgggtccagactctgctttgtaaacgggttttctatgtatgtatgtgtaggtatactttggacaccttacaacgcttgcgcctctccaacagaggcacgtcttgttattttgggcatcgttcttccccttccacttggtaccccgaacgcagtgtngactaaactccccactgccccttggacgccgatcgccttggggtgcaagtttggggtgcaaacgtctacttcgcaagagggcctgggaccgccccgccccgccccccggccgccagaggttggggaagtttacatctggattttcacacattttgtcgccactgcccagactttgactaaccttgtgagcgccgggttttcgatactgcagcctcctcaaattttagcactgcctccccgcgactgccctttccctggccgcccaggtcctgccctcgccccggcggagcgcaagccggagggcgcagtagaggctggggcctgaggccctcgctgagcagctatggctgcggcgatagccagctccttgatccggcagaagcggcaggcgagggagtccaacagcgaccgagtgtcggcctccaagcgccgctccagccccagcaaagacgggcgctccctgtgcgagaggcacgtcctcggggtgttcagcaaagtgcgcttctgcagcggccgcaagaggccggtgaggcggagaccagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgaatttaattctttcacaaaaatgatttcaaattatcctagagtataacatttttatcaaag

SEQ ID NO: 80265 - DNA, 1687 bp, Homo sapiens
agcggatggaaatctgctgtgcatccagagagcaaagtgggatgatctgtcactacacctgcagcaccacgctcggaggacagctcctgcctgcagcttccagacccaggtaaaaaaaaaaaaaaaaaaaatctgagcgggcactgtgcatgcatttcagtatcagatgcgcgtcgaacgtatcccctgtagaggcaatctgctgctgctcctaagtgtcctttggtggctgattgcagcttcaaggtttaagaaatcccatctttcaggaagcctgaggggaaggaaggaagtacgggcgaaatcatcagattggcttcccagatttgggaatctgaagcgggcccacatcttccggccaacttccattgaacttcccagcactcgaaagggaccgaaatggagagcaaagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgaatttaattctttcacaaaaatgatttcaaattatcctagagtataacatttttatcaaag

SEQ ID NO: 80266 - DNA, 1135 bp, Homo sapiens
agcggatggaaatctgctgtgcatccagagagcaaagtgggatgatctgtcactacacctgcagcaccacgctcggaggacagctcctgcctgcagcttccagacccaggaagcctgaggggaaggaaggaagtacgggcgaaatcatcagattggcttcccagatttgggaatctgaagcgggcccacatcttccggccaacttccattgaacttcccagcactcgaaagggaccgaaatggagagcaaagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattactt

SEQ ID NO: 80267 - DNA, 1212 bp, Homo sapiens
  misc_feature (1144)..(1144): n is a, c, g, or t
  misc_feature (1150)..(1150): n is a, c, g, or t
  misc_feature (1189)..(1189): n is a, c, g, or t
agcggatggaaatctgctgtgcatccagagagcaaagtgggatgatctgtcactacacctgcagcaccacgctcggaggacagctcctgcctgcagcttccagacccaggaagcctgaggggaaggaaggaagtacgggcgaaatcatcagattggcttcccagatttgggaatctgaagcgggcccacatcttccggccaacttccattgaacttcccagcactcgaaagggaccgaaatggagagcaaagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattacttaaaaaaatncggctngttggcctcagcgggggactttgcggcccttcccttcantgaggctaataatcaccatggtc

SEQ ID NO: 80268 - DNA, 1377 bp, Homo sapiens
cgcgcttctccatgaagattcttgagctttctctgaagaaaggagtgcatatgctgcagtgtctctgtggaaggagcctgaggtccagcgacacgccaagtgaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgaatttaattctttcacaaaaatgatttcaaattatcctagagtataacatttttatcaaag

SEQ ID NO: 80269 - DNA, 1162 bp, Homo sapiens
tgtctagatttttcttggcctttctgagtacgtattcctttcttctgagtgtggtgaggaccctctctggaaagggaatcttattacctacagttaaacaaggatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgaatttaattctttcacaaaaatgatttcaaattatcctagagtataacatttttatcaaag

SEQ ID NO: 80270 - DNA, 1114 bp, Homo sapiens
cgtacgcaatattcaattttaaattggtaatatatatcccaaaagtggaatctagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgaatttaattctttcacaaaaatgatttcaaattatcctagagtataacatttttatcaaag

SEQ ID NO: 80271 - DNA, 1108 bp, Homo sapiens
  misc_feature (16)..(16): n is a, c, g, or t
  misc_feature (19)..(19): n is a, c, g, or t
gccccccccccccccnccncccccccggaagtcgagactagctctcacgatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaactaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgaatttaattctttcacaaaaatgatttcaaattatcctagagtataacatttttatcaaag

SEQ ID NO: 80272 - DNA, 376 bp, Homo sapiens
agctttgggtgggaggggctgagctttgcggggaccttagtttgacagggacagggatggacgaattacggtggcggagctgcgggaggcggtaccggctctgctcggggagccgctggcgggtcctgagctggacgagatgctccgagaagtggacctcaatggggatggcaccgtagactttgacggtgagtctccttcccggaaaaccctcccgtgcttccagggcctaggctgagcccagcacctcctgggatccctgacgtggactgacccaagccctgcccttctctcccgcagagtttgtgatgatgctctcccgccactgaggctccaggagggaatatctgttgcccctgcggccccagacaccagc

SEQ ID NO: 80273 - DNA, 309 bp, Homo sapiens
agctttgggtgggaggggctgagctttgcggggaccttagtttgacagggacagggatggacgaattacggtggcggagctgcgggaggcggtaccggctctgctcggggagccgctggcgggtcctgagctggacgagatgctccgagaagtggacctcaatggggatggcaccgtagactttgacggatgtttgtgatagatgctctccctgcccacttgaggctccatggagggggaatatcttgttgccccttgcgggcccccagaacaccatgccatgacccatggcttgcaggccttcccccc

SEQ ID NO: 80274 - DNA, 2293 bp, Homo sapiens
tttttttttattagcactatcctggtgtgaagtcatatctcatcatggagatttgcttttttaagttcaatattgtgtttctaagattcatttgtgttgtcacatgtaagctgttcattccttttcactgtgatataatactgtgttaaggtagcccataatttattcattattaatatttattcattgttactattttagttactattcatatattaatatatgtatatatatcaataatttattatatttataataatttatatattattcattgttctattgatggatgattcagtgttcaattttttgcttctatgaacagaatattcttgtacatgtttcctggcacacatgtgcaaaagtttatctagactgtgtataaatctcagagtggtattgctggtccatagggtatacaatactcaagtttacgagataatgccacccatgttttccaaatgtctctatcagtttgctttcccattagtgtataagacttttgtctctcaatgtcccacttggaactatcaggcccctttttgccaatttcatggatttctcaatttgcacttccctggaggctaaacatatcttcatatgtttattagtcctctgattgctcctttttaaaatgcttatcattgtgtcttttgcccattttttaaaatttgctcatttctcttattgatatgtgtagattattctacacattaatattttatcagttatatatgttacaggcatctagtttgtttttttcctttgtggtgttttttcgtaaacagaagttgttgattttaatgcagttcctcattaatgctataccttatatttactctgtcttaaagccacgtttagatggatagccatctcattcttgtagccaagcatgtttattgtaatttttcttccatctctgaaataatttgcttgtcagactctatagggattattcctctgtatgtggtactttaaaaaaaaaactttaaacatgtcaaataatggaaaagattggagaaaatatcataaggtgattcatacttaaggccatgccttatagatagaatacatacttaaatttgattggtgaaatattctgcagctcttctagatggcaggtgatagtaaatacacaaaaattgtggttctaccaatagcatattcattccttctataacaaagcttatattaatgagagaacagaagatgaaattaaaacagactttattatctcttaaaaagccatgagacttaacagaagttaaaagcgtgtttttttaattcaggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatgattcaagtggaagatgacttttaaaataatattttttaaatatatatttttaagtagtatgactaaaataaagatgaaccagcaaaaggtcagtttgcacatttgtaaatgtatttatccttaccgaattacatgtcagtctgttgccaccttctttcatgcacattcctctttggccaaactggctgctctttgtttgtaagcttttgttcctctctcatcccatacttttagcctgtgtcaaatgtaagtcccaagtatttccagcaggaagtaatgtcttcctcagcctcaaccagggaccaaccggctgcttacttttgcaaataaaattttactagaacacggccatgccattcattt

SEQ ID NO: 80275 - DNA, 1968 bp, Homo sapiens
gtttcggtaggagccgggcgggagtcgccggggcttcttcctgtggtgcagcttcgggtctcggagtttggcccctactctgaccccaccccagctccgctccgccttgggttccggcagaacccgccttgcggtagccatggcagcaggctccgaggcgaccactcctgtgatcgttgcggctggggctggaggggaggaaggtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatgattcaagtggaagatgacttttaaaataatattttttaaatatatatttttaagtagtatgactaaaataaagatgaaccagcaaaaggtcagtttgcacatttgtaaatgtatttatccttaccgaattacatgtcagtctgttgccaccttctttcatgcacattcctctttggccaaactggctgctctttgtttgtaagcttttgttcctctctcatcccatacttttagcctgtgtcaaatgtaagtcccaagtatttccagcaggaagtaatgtcttcctcagcctcaaccagggaccaaccggctgcttacttttgcaaataaaattttactagaacacggccatgccattcattt

SEQ ID NO: 80276 - DNA, 2050 bp, Homo sapiens
gtttcggtaggagccgggcgggagtcgccggggcttcttcctgtggtgcagcttcgggtctcggagtttggcccctactctgaccccaccccagctccgctccgccttgggttccggcagaacccgccttgcggtagccatggcagcaggctccgaggcgaccactcctgtgatcgttgcggctggggctggaggggaggaagaaggctacccagttatatctacccaagtatgaaccattttgggaataatcaaagccatgtgatctattggctctaatgtaaggtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatgattcaagtggaagatgacttttaaaataatattttttaaatatatatttttaagtagtatgactaaaataaagatgaaccagcaaaaggtcagtttgcacatttgtaaatgtatttatccttaccgaattacatgtcagtctgttgccaccttctttcatgcacattcctctttggccaaactggctgctctttgtttgtaagcttttgttcctctctcatcccatacttttagcctgtgtcaaatgtaagtcccaagtatttccagcaggaagtaatgtcttcctcagcctcaaccagggaccaaccggctgcttacttttgcaaataaaattttactagaacacggccatgccattcattt

SEQ ID NO: 80277 - DNA, 2201 bp, Homo sapiens
  misc_feature (2200)..(2200): n is a, c, g, or t
gtttcggtaggagccgggcgggagtcgccggggcttcttcctgtggtgcagcttcgggtctcggagtttggcccctactctgaccccaccccagctccgctccgccttgggttccggcagaacccgccttgcggtagccatggcagcaggctccgaggcgaccactcctgtgatcgttgcggctggggctggaggggaggaaggtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatgattcaagtggaagatgacttttaaaataatattttttaaatatatatttttaagtagtatgactaaaataaagatgaaccagcaaaaaaaaaaaaaaaaaaaaaaaaaaaacaaaaaaaaaaaaaacaaaaaaaaaaaaaaaaaaaaaaaaagagaggggggggcgcgccaaaaagtaccccccgggggggccccagatattacccacaccccgtatttgttagtcacacaaggaggcccaagagagggggggttataaaaaacagcaggagagacgaaggcgacggcgcgagacaacaagaagggggagcagagggagaaaaacgcgagcacgcggggaacctcggagaggagaaccccacacgccggggggggaggcacaaatggtgcgcagcaaacctccccaacaagggagaatataaaaccgccccacagaggaggacaatcaacatcaccccacacacagagggagacaaaaggggggaaacacacacgagccgcaaaaacgacgcggcgcagcaaaaaaagcatggccgccaagaggattcataccaccacaccaattattacacgggagggcgcacaacacggtggna

SEQ ID NO: 80278 - DNA, 1964 bp, Homo sapiens
agcggggtggatatgtggtactcgcgtaatatgtggcgtgaaactgaactcagcccaattctgatccggcttgtggttcctggcttaactactcacattgtggccagtacagtgtgacaagacataggcgtccgagggtagactcacatctctgcagatcgtggcggctggaggcatggagggcgaggaacggtggccaatgtacataccgtgaatctcgatgagatgcgctagatgaggatatcatgttgtgaacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatgattcaagtggaagatgacttttaaaataatattttttaaatatatatttttaagtagtatgactaaaataaagatgaaccagcaaaaggtcagtttgcacatttgtaaatgtatttatccttaccgaattacatgtcagtctgttgccaccttctttcatgcacattcctctttggccaaactggctgctctttgtttgtaagcttttgttcctctctcatcccatacttttagcctgtgtcaaatgtaagtcccaagtatttccagcaggaagtaatgtcttcctcagcctcaaccagggaccaaccggctgcttacttttgcaaataaaattttactagaacacggccatgccattcattt

SEQ ID NO: 80279 - DNA, 428 bp, Homo sapiens
ggtaggagccgggcgggagtcgccggggcttcttcctgtggtgcagcttcgggtctcggagtttggcccctactctgaccccaccccagctccgctccgccttgggttccggcagaacccgccttgcggtagccatggcagcaggctccgaggcgaccactcctgtgatcgttgcggctggggctggaggggaggaaggtaggtgccaggctgaggtccgaccctgagtacaaacccaatgccagttgactctcgtggcacccctcgtggggccgtttgccttagccccaacccaggtctctctggccttgcattagactatgaagaaaaatctatattttctagtgagcgtggcatttctcgaattgtggcatccagatttttgatcgtcgtagggtagcctacgagtgctgtttcacgcatggggt

SEQ ID NO: 80280 - DNA, 396 bp, Homo sapiens
tggtctcgaactccaggcttcaagtgatccgcctgccttggcctcccaaagtgctgggattacaggcgtgtaagccactgtgttcggccaatatttattgttttattgaagaaaacatcctgaaatgttaagaaatcttctaagaaatcttctcagaagattaaaagaataaatcttaaatacattcatatgtttagcaaacattagctttatcttttttggcttttttcttttaggagaaaaggatcaaatgtcttcttggttattacagctagatattctgtgtatgtttttcggtaaattgttcattacctatactaaaaggaaaaggatgtcttttctaaacaatagttgtaacatagctgataaacatattgacagtttagcttatcttag

SEQ ID NO: 80281 - DNA, 243 bp, Homo sapiens
gcaagaggattgaggatctggggccacggtctctgaggggaccaaggagacagcctcacagaggaggagagtctggagggctatatggagagagaggagagctgaaaacaaagaggaggaagaagggaaagaagaaggcacatggaagagaaggaggaagaggaaggaaggaaaaacaggagcggggcttgtcttcctctgagtggtagttcctgggatctgtccaatatactcagtctcatt

SEQ ID NO: 80282 - DNA, 274 bp, Homo sapiens
atattccacagatttcaaataggaagctcatacactttgttaatgccacaagtaaggaggaaaacaagaccaccacattcacaatcttaggccattgttagtggctatttggtaactttttccattccttctctaattcgctcagattgaacctaaaaggacaatatgcattactttatttccctcagaacaaatcagtataactacttagataaaacttaacttgtctctgcatcattatagtcttttctctatatcgtagccagcggtcttt

SEQ ID NO: 80283 - DNA, 592 bp, Homo sapiens
ggaatatttccatcattaatgtataagcgctccattgatccataatctctcctaccttggtattatcaaatgtctgatttttgccaacctagtattttaaaatggtgtctcattgtcatcttcatttacttttctctaattactaataggattgataattacattgtttatttggccatatacgtgtcctattctgtgaaatatctatgcccatttttctgtgttttatcttaattgatttgtagaaattctttgtatattctagaatatagataatgttgcaaaatatcttcttgcagtttgtggttcatcttttcaatttcttttcttttgaggaaaaaaaacttttagtgtggaatttatcactatgtttgtgtcttgtttgaatccttctcttctgcaagatactatgtggctaatgatttgcctgaggttttttgtattttctgtgtaagtaatgccaattgcatttctttccagttcttatccttctaattaatttattgttctttattactatgttaaataagaaagacctctaatgcaatatttaattgaagccagttatttaattgtaggggtcatccttctc

SEQ ID NO: 80284 - DNA, 717 bp, Homo sapiens
agcggataaatatatattaggtaggtagtcataacacatttgttttagacatttattcaatcatttgtcagtcttattaaatacctatcatgtgtcaagaaccaatgctaggttttgaatttaaaaatggaaagggctaaatagctacatgatcttggatgagagtacacacacacacacacacacatacatatatatatgtggtccttcataaatctaaaatgctgtaattattaggtaatctgcagagtgtattttttttcctcagtccctttgggtgtgactgctgtacacattttcatgttaccattgacatcttcagtttttcaatgtgatgtgtaatgcatataagcagcatatgtagtggttgaagagtacaggctgtctggagtggcacagcctgggattcagtttacatctctgtgcctcagtattctcagctctagcatgttgataataatttccttcttcctagggttttggtaggattaaatgagttaatacatgtaacacatttagaacaatgcatgacacgtaataagcatttagtaaaagctattattagtatacatgtgtgaaacaggaaacataatttttaaaagtatatcaggcagtagtgtaaaggtagatccctttgtatactggtaaatgccaaaaataactttaggtagcctctttttgttgggtagtgtcatcacttcctcactgggaagaaat

SEQ ID NO: 80285 - DNA, 412 bp, Homo sapiens
gtttccaaacaaaaaaataaataagtgaagtagaaagggtttgatgtttacatttttaattattttccaggccttatgtgtaaatattgtggtggtagaataagatccagatagcaatttattggaccaggtgtggtggcttatgcctgtaatcccagtgctttggaaagctgaggcaagaggatcacttaagaccaggagttcgagaccagcctgggcaacatagtaagactacatctctacaagaaagttttaaaattagccaggtatggtgtcatgtgcctgtagtaccagctactcaggaggctgaggcgggaggatcctttgaggccctgagttggaggctacagtgatacggtcacaccactgccttccagcctgagtgacagagtgagaccccatctcaaaaaaa

SEQ ID NO: 80286 - DNA, 415 bp, Homo sapiens
atgtcaccaacaccgacatgtttcacagaacctgaccagcacctgcaaggtctgacttaatatgatagggttgaagagaaaataaaaacttttaaatttaactccattagtaaaaagaagatcatgttataaaggataaggtaaaattatccataaatggttgtcagcaaaatttgacaatctcctctttaaagtacactgaaccaagaaaaatctgttcaagtatttagaagctcattttagaaagtattactacaaattaggcttctttatctccagtataccatacactatgtccatgatttgacaagttcttcctaattgcccaccttaattacagtaattatatatattatagtaaatgcaagtaacaaggttcatttgaaagataaattgtgaactacagggtttttaa

SEQ ID NO: 80287 - DNA, 355 bp, Homo sapiens
actgggccaaaaaaggcactaaaacttccttaatctctttcctggacctcttggtgcaggggtgcgagatgccatgttgtagggacgctcaagcagcattacagagttcacatggtaagatactgaggtctcttagtaacagtgacgtgagtgagccacgttggaaacagacccaccaggtccaatcaaaccttcagatgactttagctcaggcagtgtcttaactgcaaccacatgacggacactgtgccagaaccatccagctaaaccacatcccaaatcctgacctataaaaactgtaagaaactaatgcttgttgttttaagctgctaaattctcgcgttatttgctacgt

SEQ ID NO: 80288 - DNA, 586 bp, Homo sapiens
atctgtaaaaccaactgtgacctttatcctagagcttcaagaaagtggcttaataggggattacaatattcatgtttcatgtcatcccaggaatggtctttggtccttattctactgcgttctcactgtagggaaccactgtagattcctaccacaccactaattccagttctggaaatgaattcataaaaattattcaacagaagcaaaaaaaacctacatgtttgaagatgttcactgtgcttaaaaattggaaatgatacagcacatagaagatataaaatattagaggactaattgtgcaagttataggaaatctgtgtgtggtatattatttaaacattagaaatgataatgacaatgcctttgccacatagtggaagatgtctcttatatcatagtaaacagaaaaggtagaatataaatcagtatgtacctttggcaatcagttggcatgcatgttgaaggctgtttgcaaaagataattatgttaggataatgaggtataggtgccaagcacggtggctcacacctataatctagcacattgggaagccaaggcaagaggatcacttgaggccagaag

SEQ ID NO: 80289 - DNA, 642 bp, Homo sapiens
atgccagtaagttgtgtctgttaatcaagttgaagtactggtggcagttctcaagcttttctgtctgctgatgatttcacacttactgcttctaattaaatagtgtgtagtcgatttgaagaagccttgcttctctttgacccaccagttctgtaaaggtaaaagccttcttagagtgttgcccaggtaacaacacatacagagactgcttaatagctcatcatggaagtgtgtggaaaattttggaaatgttggtaaagaagttgctatagtaaataactacttggttggtaaaaagctgggctacttctggatagttgataaagagtttttgagatgagccgtggttctaaaataaatatgaattgtgtcattgccacacgattttcttcagttatgtaagctcctaatatgtaaatgttgtcctaccattttagaaggtgtcagcagtttcatgtgacctgttccacaatatagcacaccccaaacaccacgataagagttcaaatatggcatggcccagatgcctcacaccagttaaatgataaagctaatcatgtcagcacagtgtttctgttaaagttttttccccctcttttttgaggcatgttagttttcacgaattgaggttattagaatctt

SEQ ID NO: 80290 - DNA, 2518 bp, Homo sapiens
acaatttgcttctggaaacaggacagccggggccgtgttcctgcaacagcagaccaagcaccgcggcggacccaggcaagcacggaacaagctgagacggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaatgataaaaaaggaactgtcaaacattaccacgtgcatacaaatgctgagaacaaattatacctggcagaaaactactgttttgattccattccaaagcttattcattatcatcaacacaattcagcaggcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 80291 - DNA, 2611 bp, Homo sapiens
tggaggtgcccggatgaacatacatcacaatgtgaacagtggtcatctccagatagtagaatttcagatatgtttctttccatttttctgacagtttgaattttctgtaataattaattgacttttatacaatggaaacaacttttttgttttggaaaaaagaaagatgctgccgctaatcagtggatgaaagatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaatgataaaaaaggaactgtcaaacattaccacgtgcatacaaatgctgagaacaaattatacctggcagaaaactactgttttgattccattccaaagcttattcattatcatcaacacaattcagcaggcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 80292 - DNA, 2510 bp, Homo sapiens
tgatggtgcctcaaagcagtaactttttgcttagagcttgagagtcaaagttaaggacccacatgtatacttcggctctagcgagtctaaggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaatgataaaaaaggaactgtcaaacattaccacgtgcatacaaatgctgagaacaaattatacctggcagaaaactactgttttgattccattccaaagcttattcattatcatcaacacaattcagcaggcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 80293 - DNA, 2479 bp, Homo sapiens
tgatggtgcctcaaagcagtaactttttgcttagagcttgagagtcaaagttaaggacccacatgtatacttcggctctagcgagtctaagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaatgataaaaaaggaactgtcaaacattaccacgtgcatacaaatgctgagaacaaattatacctggcagaaaactactgttttgattccattccaaagcttattcattatcatcaacacaattcagcaggcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 80294 - DNA, 2483 bp, Homo sapiens
tggaggtgcccggatgaacatacatcacaatgtgaacagtggtcatctccagatagtagaatttcagatatgtttctttccatttttctgacagtttgaattttctgtaataattaattgacttttatacaatggaaacaacttttttgttttggaaaaaagaaagatgctgccgctaatcagtggatgaaagatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaagcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 80295 - DNA, 1029 bp, Homo sapiens
acaatttgcttctggaaacaggacagccggggccgtgttcctgcaacagcagaccaagcaccgcggcggacccaggcaagcacggaacaagctgagacggatgataatatggatacaaaatctattctagaagaacttcttctcaaaagatcacactcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 80296 - DNA, 1878 bp, Homo sapiens
tggaggtgcccggatgaacatacatcacaatgtgaacagtggtcatctccagatagtagaatttcagatatgtttctttccatttttctgacagtttgaattttctgtaataattaattgacttttatacaatggaaacaacttttttgttttggaaaaaagaaagatgctgccgctaatcagtggatgaaagatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaatgataaaaaaggaactgtcaaacattaccacgtgcatacaaatgctgagaacaaattatacctggcagaaaactactgttttgattccattccaaagcttattcattatcatcaacacaattcagcaggcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttgctgctgtatttgaagtaatgaaacacctctggagctgaccacttgactggaaacttggttccgact

SEQ ID NO: 80297 - DNA, 572 bp, Homo sapiens
gctgggattatagacacatgccaccacatccggctaagttttgtattttttagtagagacagggtttcaccatgttggccaggctggtcttgaactcctgacctcaagtgatccgcctgcctcctcccagagtgctgaaattacaggcgtgagcccctatttctgttctttaccaggagaaatgtgtaagttagacttgattgactattataatagtcaaaccaagccttaatttcattgatgtctttaaatcctcaagttctaggactttcaccaacaacatattcattattattcattatggaaaagcagctaggtctgaatttgctgtccgtgatctttggtgtcactgaccacaatttttaattgtcttgcctctgagagctcataaaagataccccatgagaatattaataagtaaattactgttaatccccatagacatttatgtattaggttctgttttgtcatcgaggttttggtgtacatgcccagtcccaggagacagaatgtagtcttttcatctgtaatatcattaatttgatttggtactgagttttttgcttttttct

SEQ ID NO: 80298 - DNA, 2297 bp, Homo sapiens
  misc_feature (1135)..(1135): n is a, c, g, or t
aaaagaaacaaaattaacctcatagtctgcatactctcgaaatggcaaaaaagcctgcaactttccgttgtggaaaataatatacctgggtgataaactgagcaaacatcacccttgcccttgcctctgaaagagagcctgttctagttcatcctggggccagcttggctggaaccccactggccagctctgtccacaccttgcatattaggacagaaatctgcctaccacattccagctacataaagaaggtggccagcacctgactgcctctttctccttgtgaaattccttggaaataccatttgtgactgcttgggcttgttctgaagaaaattcaaatcttgttctgtttaacaaggattgattgaagaacccgtaggctcagtgctagtacaaagataagcaaggaaggaactcagaataagagagaaaaaacttggataataattatcaaaaccagtatttattgagcacctactgtgcccagtagagtagtaattacaggaggtaaatatctaaaacttacatagctcttcacagaacatacatctgttcttgcttctgtgtttgattttattagctttcctctgtacacataagcttttagtgtatgtcctattattgaagtccagagttttattatttttcacttatttgggcatagatagttccagaatttacttgtcttcctcattctcattgttaatctcatttttcttccctggagaatatggactttcaaaactatttttcaatcaaggccaaaatatttcttaaaattcacttctatttaaaacacagataacatccaggagaaaatctgagaagaaaaaaaaaaacgattttgatggtacctgattataaaagactcacagtactaagttattctttggcacgtgtagcaaaatactatgtaggtgtcatttcgagttcatagtaaggggagaaatggtgtcatttttcctgcagagaaatttaatctttcactttaatctttcattggcctatagcagccagtggggtcttttaaaaaattcttttccttcatattccccgtttgagcttaaggtacaaaaaaagaaaatactcttgaaatgctgtgaccagatctagactgtaacatgccccttcnctcctctggtgaggaagtgcgggaaggtggaagacattgaggggttgattatttacttcgtttggaagtaagaagggaggtagctcttatttggaataagagctgtcttcagaacaggtgtgtgctctcctgaagcccagagctgtgactccctgggtgtgtctcttacctgtgcccttgggcaggtggcacgggagaagaatacgataagaggaggatggtacagacagaggagtcacaggctgaacaggctgtcaccggggcaagatgactgacaggtggatggaattcaccatcctttcctttcaatcaaaaaaaaggtagaaagttgctcataagtaagtttgagttatatcatcttcttcatagccgttgctcttcagacacaggtgctggtaatcaggaaaatgcaaggaaacagctctggggaaaaggaacaagcctcgttggccttgagagccccagtagaccatcaggccttgctttggatattgggaggtgacagtgccttctcacgtgcctgacagtttccctgcaccaccaagactctgtgtgactgaggccgtggcccgggtttcaggatgggcattcagaggaaggaagttccccctccttcacttacctcacgcttactagatgctgggttgcctatgcccatgttaaaggaagccagataactttctgtccccatgtgatccaggcccatcctgaagcctgggggttctgaacataagtatggcggttgcagccttccttctgtgacttctggaattcctgacagagagggtcatatctagccactgtcaaccggatgctagacttgttttgttaggcccttcctccttcccttcctctacttatcttccaataaccttaggatttggaggaaattaaaataaaccttcttctagaaaggtgtcagggacccatgcacaaatgtagcctttttgatgcttgagaaagaatgcctttttgacttccgtgaataaagaataagtcacggctaatgagtaagtaacagcacgtgcctgtggtcccagttattcaggagactgaggcaggaggattgcttgatcccatgagttcaaggctgcagtgagccatgattgtgccactgcactccagcctgaacaacagagcaagaccccatctcttaaaaaaa

SEQ ID NO: 80299 - DNA, 835 bp, Homo sapiens
gttttgttgtataaaggacatgtaggagggaatgtgttcgaatgcacatgttagaactgtgttcactctgcaaatatggatatgatctccactctgggatgaatttgaggccaagctacagggataaagaggaaatgtcaaggtctctgcccttaaggggctcctagtcctagaagcaggctataacaagcagagtgataaactcttttgttgtgggaaatcagggaccccaaatggagggaccagctgaagccatggcagaagaacgtggattgtaaagattccatggacatttattagttccccaaattaatacttttataatttcttatgcctgtctttattgcagtctctaaacataaattgtaaagatttcatggacacttaacacttccccagtcagtacccttgtgatttcctatgcctgtctttactttaatctcttaatcctgtcagctgaggaggatgtatatcgcctcaggaccctgtaataattgcattaactgcacaaattgtacagcatgtgtgcttgagcaatatgaaatgtgggcaccttgaaaaaagaacaggataacagcaattgttcagggaataagagagataaccttaaactctgactgccggtgagccgggcggaacagagccatatttctcttctttcaaaagcaaatgggagaaatatcgctgaattctttttctcagcatggaacatccctgggaaagagaatacgtgcctggaggtataggcttataaacagcccccctaggtgcgcctgtctcttatggtcgagactgcaggggtgaaagagactccagtctcccatagctctcccag

SEQ ID NO: 80300 - DNA, 894 bp, Homo sapiens
agcttatcttgaagatcacatcttgcaacacagagcttaccttactataatatgctggatcttagtagggatgattttccttagataaactatgcaccctccagttctccacagcccccaccattccctcttgcctccccaaagactgaggaaaaggatcatctactgtttatcattttacacccagcctgagcaatacacatgtattcatttatatttcttcttggctaatgtaggcttatgaatatttaaccctgatgttttagtttcttaatgctgccatctaacaaattaccacaattttaatggcttaaaacaacactcattaattatctcacagtctgtaattcagaagtctagacactgcatggctcaactggttctctgctccaggttccacaaggtcaaaatcaaggtgttggcagggttgtattcctttccagaggccctagggatggattcacttccaagctcacttagttgttggcagaattcagttccatgtggttgtaagactgagatccttatttcctggctggttgtcagccaggagctgttctcagcaactaggggtgcttgcatttcctggttggcggcccttttcctccatctgtaaaatcagcaatggcaggtgaagtccttctcattcctagaatctctctgacctccccttctgcctcatctctcctctcccttcctcttccaccacatcttctaccttcctcttctcttgctaagggcttgtgggattacatttgtattagtcagggttctctaaagggacctaataggatagatgtgtatataaaggggagtttattaaggagcattaacttacaccattacaaagtgaggtcccacaataggccatctgcaagctgaggagaaaagaag

SEQ ID NO: 80301 - DNA, 1818 bp, Homo sapiens
  misc_feature (858)..(858): n is a, c, g, or t
tccgggccacgtggtgcgcgcggcgggcgcgtccgaggagcctgcggctgctcctggctcacagcgctccgggcgaggagagcgggcggacgcggggggctgggccggtgcgggcggcgaggcaggcggacgaggcgcagagacagcggggcggccggggcgcggcacgccggcggcgtcggggccgcggcctctgccttgccgctcccctcgcgtcggatccccgcgcccagggcagcacggtggagagggacgcggcggagccggccggcagccatggaaccggccccctccgccggcgccgagctgcagcccccgctcttcgccaacgcctcggacgcctaccctagcgccttccccagcgctggcgccaatgcgtcggggccgccaggcgcgcggagcgcctcgtccctcgccctggcaatcgccatcaccgcgctctactcggccgtgtgcgccgtggggctgctgggcaacgtgcttgtcatgttcggcatcgtccggtacactaagatgaagacggccaccaacatctacatcttcaacctggccttagccgatgcgctggccaccagcacgctgcctttccagagtgccaagtacctgatggagacgtggcccttcggcgagctgctctgcaaggctgtgctctccatcgactactacaatatgttcaccagcatcttcacgctcaccatgatgagtgttgaccgctacatcgctgtctgccaccctgtcaaggccctggacttccgcacgcctgccaaggccaagctgatcaacatctgtatctgggtcctggcctcaggcgttggcgtgcccatcatggtcatggctgtgacccgtccccgggacggngcagtggtgtgcatgctccagttccccagccccagctggtactgggacacggtgaccaagatctgcgtgttcctcttcgccttcgtggtgcccatcctcatcatcaccgtgtgctatggcctcatgctgctgcgcctgcgcagtgtgcgcctgctgtcgggctccaaggagaaggaccgcagcctgcggcgcatcacgcgcatggtgctggtggttgtgggcgccttcgtggtgtgttgggcgcccatccacatcttcgtcatcgtctggacgctggtggacatcgaccggcgcgacccgctggtggtggctgcgctgcacctgtgcatcgcgctgggctacgccaatagcagcctcaaccccgtgctctacgctttcctcgacgagaacttcaagcgctgcttccgccagctctgccgcaagccctgcggccgcccagaccccagcagcttcagccggcgcccgcgaagccacggcccgcgagcgtgtcaccgcctgcaccccgtccgatggtcccggcggtggccgctgccgcctgaccaggccatccggcccccagacgcccctccctagttgtacccggaggccacatgagtcccagtgggaggcgcgagccatgatgtggagtggggccagtagataggtcggagggctttgggaccgccagatggggcctctgtttcggagacgggaccgggccgctagatgggcatggggtgggcctctggtttggggcgaggcagaggacagatcaatggcgcagtgcctctggtctgggtgcccccgtccacggctctaggtggggcgggaaagccagtgactccaggagaggagcgggacctgtggctctacaactgagtccttaaacagggcatctccaggaaggcggggcttcaaccttgagacagcttcggtttctaacttggagccggactttcggagttggggggtccggggccc

SEQ ID NO: 80302 - DNA, 579 bp, Homo sapiens
gcccacccccgttattcttcactttcacttgacatcgttcttcactcaaggttaggtcctcgctagtgccagagaagcccctgggtccccagtgccctcagccccgcagcgtagggagcagccggcccgggagataaggaggccacagccatggaggccccaggcccggagtccccgcgccgtcgggttttgagccgcgcggctggccaggaccgccggctccttctctgtcccggtcctccgctcgcagccccgcagaggtgacggtacctggaggctggaagcgacggtttcctcgggccggtggagggaaacatgtcagggtcacagcgaaggaaaccgagacccacaggggtccccgggcgtccgggacgcgtcgctggttttgctcctagaaggaaaggccttcccgcttttgttccaccggctcaccaggtcctcccttcctggccaactctaacctcagctttgtgcgtgtcacccggccccgggataatcggatcctcccagacccgggaatccatcagaagcgctacccgtacttggcgccctgaaagttccccaagcgcagcggccgcg

SEQ ID NO: 80303 - DNA, 348 bp, Homo sapiens
tttgccataatctgcataatcagatttcatataaatcatctaatagaatcacagaactttatttttaaaaggtagctgaaaggaaaagtaaaataaacattaaaaccaagggttatttttctaaaatgcttttatttacttttaattccaaacactcacaaaatacaaacactggtcccctacataattgcaaaggattagaattaagatataggcagtagcatttctttaaacaataaattgatatttattctgaataatgacagttaagcattgatgaagtaaagcaaattcctagacattactccctaataaatacgctgggcagtgggggaaaacatggcagtt

SEQ ID NO: 80304 - DNA, 852 bp, Homo sapiens
  misc_feature (400)..(400): n is a, c, g, or t
ggatttcaccatgttaggcaggatggtcttgatctcctaacctcgtgatccacccacctcggcctcccagagtgctgggattacaggcgtgagccactgtgcctggccaattttttttttttttaaagagacagagtctcactttgttgcccaggctggtcttgaactcctgggctcaagtaatcctcctgccttggcctcgcaaagtactgggattacaggtgtgagccaccacacccgggctctgtgatttgtttgttttttgagatggagtctcgcactgtcatccaggctggagtgcaatggtgcaatctccgctcactgcaaactccgcctccctggctcaagtgattctcctgcctcagcctcccgagtagctgggattacaggcacatgccantgcgccaagctaatttttgtatttttagtagaaacggggtttcaccatgttgcctgggctggtcttgaattcctgacctcaggtgatacttgcctcgccctcccaaagtgcttggattacaggcgtgagccagtgcgcccagccgcctctgtgattttttaaattgtgtcactcacactaaatttaacagcaatttttttgataactcattttttttgtagtctttctagaacattaaacttagttttcatagaaattgcaattctctttgtatttaattaacttacataattaaaataacaactggcataaacagacttggggaaaacttaaactcttggtaagtttaaaactcaattgagtggagtagaagtatacagaaaaaaaacaggaattggagaataacctattaaacatgaatatttagtgttcttttggcatcagtcggtatg

SEQ ID NO: 80305 - DNA, 300 bp, Homo sapiens
tttcaccatttaccttttgttttgctgaagtttatcctttagtagtttttttgagaagggattggctaacattcttctgaattctcacctgtttaaaatgtttggctattggctgcatgtggtggcttatgcctgtagtcccagcactttggaggccaaggcagaaagattgcttgaggctaggagtgcaagactagcctgggcaacatagcaagactttgtgcatactaactggtggtggtggtggtgcatatttgcagtctcagctacttgggaggctgaggcaggaggatcgcttga

SEQ ID NO: 80306 - DNA, 811 bp, Homo sapiens
agggagggagggggaagggaggggaagggagggaaagggaagggaagggaggggagggggaaacagacaccagtcagagcaatgcttaaacttaaggaggcaactgaggttagtggaccatgaccttatccacattcctgacccttccttcctccctctgtccctccttcccttccttcctttcttctttcctttcttccttccttcttttccttctttctacaatgaaatactatattattcctgaataattttatgactgaaaatcattatcttttaaaaattttttcaattatttaagctgctctctaaggaggttccagtgcttcctcattggattgactgctgatatgttcagattgacaaaaggccctcagaaaaactcccccagggtaatttaaaaccctgtacttccttagggctcacacaacctttctgaaagtgtttggtttttctgtgccaaattgtgcatggaaatcttggcgatagctctcacaccttcatgcccagggttcagcttcctgtggcacctgcagccatccccattttaggtaccattagccctggggcctttcatatgagctgtgtgcaggtgcttgtcatttacaggatccacaaaccccccatccacccaaggacccagggatccaaatctcctcatgggtcacaccatccctttctctcaaattcatgcttttctggctctagtcttcaatggcccacatatctcaaataaagcactggtgttgctggcttcaggatatctccaagacacaaaaactatattaattatccttaggagtccaagaaa

SEQ ID NO: 80307 - DNA, 439 bp, Homo sapiens
aagtgttcttcccaccgcagcctcccaaagtgctgggattacaggtgtgagccactggacccggcaggaacaatatacctcttaaagcttctgctcagacgtgggaatggctatgtggtgcgtgtcagttcccctcacattgcattggctgaagcaaaccctggggcccaaccagtgttggcggggttagaagtagacccctcccatagggaggccagggagggaggattttgagccaagaccactcaccacgtgctgtgatgagcagttgcctccccctcctttcgtgtcttcgtgcctcctcacgtattcttacaagtagaattgctacattaggaatatgcatatttgtaaagtatttactatttattatgtcagctaggttttaactgtcactgcatttgctgtgaattataggtaattattcatcctgatgacc

SEQ ID NO: 80308 - DNA, 336 bp, Homo sapiens
gggcaccaaaaaaaaaaaaaagttactgaatacaagaagtagtcagaatctagtgcaacaagtagggaattcccctaccccaacctcaatccgagtggaaaaacatcctccagtccaaatcacacacttgcaaaacgcatgatgctcaatcagggtctagctgtacagctcagaacagttctcctggaagcatgtgaatctaacaggctgatgtgagggaggaaaaaagtgactgcacagataaaaagaggaggaaagaaatgtgaaaatattcccgttgtcggttttcattgaatttctaaatgtcacaaatctttgggtaaaaatgtaacacag

SEQ ID NO: 80309 - DNA, 796 bp, Homo sapiens
ggatctggagaacaacactacacaagcatgtgtgaaagaagtctcatggggacttgtttgcattctggataaacctggttttctcattcaatgatagggtaagaaatgagaggtatgtagtaaaacttcaatactacatgatctcctcttctactcctgggtaggcctatttttttttttttttttaccttggtcagagtgtctccacatggcagcaatgttgacacaggcttgcttacagctctcaaactgtggttattaagtttatagtatcatacaaaactcagccaggtgtggtggcgggcacctgtaatcccagctacttgggaggatgaggcaggagaatcgcttgaacctgggaggcagagattgcagtgagcagagatcgtaccactgcactccaccctgggccacagagtgagacttaatctcaaaaataaataaataaataaataaataaataaagtttacaatatcaaaatctaagtcagtcatttaaatgccagttcattttcatgagtggaaaaaatttcaaagataaagttgggctctaagtttaataccttcctacagagtgtacaacatcaataattcacatattttttttgttcctagaccatgaactgttatcttcatctctaaggccatttttctgtttaaaatgaacatccaggccaggtgtgctggctcatgcctgtaatctcagcactttgacaggctgaggcaggaggatgacttgcgctcaggagactaggaccagcctgggcaacacggtgaaaccctacctccaccaaaa

SEQ ID NO: 80310 - DNA, 545 bp, Homo sapiens
caattttattaaattaatggttttttaacataaagatatacttgaaaagataacagacaccacccataatttccccacccaggggtgacagccgacagtcctgggcagctgcttttccatctcatatgtcttatttgtgtgcagtgactgctttccagagcacgctctccagcgcccaggggtccgtgtcctgacagcagtagccgggcctttctctgcactgagtggcatctccctcctaaagatactttgcttcagaatttcatcctttcacttttgaagttcctctgggccagtgtagatactttgtttcagaatttcttcttttcattgtgtaactccttctgggccagcatagcttcgctggatgagctgggctctgcaggtgaagcctccctgttaagtttctgcttttcctgactttctcagaggacagaggggtgaggcggggcagctcatgaataattttttatgttgaagacttgtcgaaataatattttggttatgttgggttaaataaaatataaagttagtctgtaaaaaac

SEQ ID NO: 80311 - DNA, 439 bp, Homo sapiens
ggaggcagaggtagtagtgagctgagatcgtgccattgcactccagcctgggcaacaagagctaaactccatctcataaataaataaataaataaataaataaataaataaataaataaatgtatgtatgtatgtatgtatgttcagaaggacaatgacattctacatgtcagaaggaaagcattctacaaaggaaatgactgacagtatcaaaagccatgaatgaggaagacgagcttgaaaggtatccactgaatttgcaaccaggaaatcattggcaaccttggacagagcagtttcagtaaagtggttaagacgagtaagactgaagtgaacagaggaaagagtagcagataaggttatggagaaactatttgaagatagtcttgctgttcatcattcctaaatacccatgaagggcagctttgcttttttagta

SEQ ID NO: 80312 - DNA, 447 bp, Homo sapiens
tacaccaccgtctattgggccgtcaatggtggaactaaaacagctaattagcacactaacgccccctctggggcttcagggttgtgggtacccctgcccaggtgctgccactttcccctcgaggcaacacgcctggtctggccacaggcccagcatggagcttgctcttgtgtcggtgtttggagtggtcagccagagcccacacttgctcattcatgtgcttcctcctgcaaggggctgagtgtggtggaccgagtagatggggtgcccctgctgcaagtgtggccaaggggctgagagaaaattcctgtcactgtggtttgctggtcttgtgactcagcttacctcattcccacagagaagtgggcagcacagcttccaagctgggctcagagtccagacctacaactctggctatgactccatgctcccaagtctcagtttccc

SEQ ID NO: 80313 - DNA, 596 bp, Homo sapiens
cccttatataactgattgtgtaatggctgaaattgagaaattggggcagaagtattgagtggctctaagaatctccaaggatccaaggtttgaatgattaccatgcacacacaaaggaacctatgcagatgactgcttagtacagagagaaactcagcacaaatggtacattgtggccacggttgaccaggaccctaaaagaagaatctgtaagattctgggagttcctatcacgtacatttctaaccatagatataacatcgaatgaatgccagatgattatggagtccttgggttctaattcttacaagacaaagtttccctgcctttctttgaccaattttcctcttgttgccagtttcctctgcctttctttgaccagttttctcttgctgccagttcattaaacatgtaatagcatgaattattattctattcacccatttgctctattatgagctgagtatgaataattatgctcactttttttaatgctgttttgaaattgatattttgtctcatttaaaaattttaaggccgggtgcagtggctcacgcctgtaatcccagcactttgggaggccaaggcaggtggat

SEQ ID NO: 80314 - DNA, 399 bp, Homo sapiens
gagaacaggaatcattatttttcattgtttaccatttatccccatagtctaccatgcccagcatgttaaggttgtagaagccagcttccaagatggcccccagtgaacctggcctcctggtattcacacccactttggcatgtttttcctttgtgcactgaatagggttagggttccatacaggatggtggttaaatttgaatttcagataattttttagtatttcgcaatattttacgagacatacatatactattattcattgggtttatctgaacttcaagtttaattgggcatcctgtatttttattttactacatcttggcaacccctattttgggctggattgtgtcacccactaaggatatttggaaaaaatgggccaggcgcagccgggaa

SEQ ID NO: 80315 - DNA, 693 bp, Homo sapiens
gtttaaaagaatgaggtacaagtatccataatttttataaaaaggaaacattaataatactcagtgagaagtgcagataacggtattatctgatgttttttatgcatacagtgtgaatctcaacgggtagcaaataggctttaagaggacatagtcgtaaaagaaggggagggagttgatttttaaagcaaaaacaaatatttgatagcagtcgctcctgatctgccaggctctcaccctgatgccttccatgttggtgcaagcctgacctagtttgacagccagagtccctctgtcattatggccgagctcagcctcaggcattcaggaggacgcggtcagatggaattgccatccccaacacttccatcatgctcaccatcgtggcgttactgtcaccgttgacatgctactttcctggccacccctcactttgcaagatcattttataatgacttctcactgtcatgtggggtgttggttagggatattacccttgttttagagttgaggcaacaattccgttccaaacttctggaaggggcttcaattgtatatacagcgacttttaaacttctttgtagctatcgaacattttcattccagcactttgggaggtcaaggcaggaggattgcttgatgccaagagttcgaaaccagcctgggcaacatggcaacaccctgtctataaaa

SEQ ID NO: 80316 - DNA, 324 bp, Homo sapiens
tgtcttagtagtaagggaagagagcaagggagagagagagtgatttgtatcccaatattgcattattactcttcatggatttagtcatttgattcaatgaaatttaaaatgaatcatttaagtttcttcatgttagttaaccagtctatattttgcacaaaatgattcttctatttctttggagtatttcatgaagtgatataaaattatcacccttgtcttgaaaaaaaaaatctcctaaaaaagtaaacaaatggaggtacaaaaacaatcaagcaaatacaaactaagaaagcaggagtgggccgggtgcagtggttcaca

SEQ ID NO: 80317 - DNA, 946 bp, Homo sapiens
ttcaagcatttgggaaaacaatgaggaggcagcttattcccagctccaggcaggaggagacctgcagagggtgagattctcaggggaggaactgccagaagcctaagagcctttttccagagctgcctccaggagagaaggtgatctacctggctccggatcaagtcctttctgctcagaacaagctttctgcacttgtagggtgggtgattttagagatttggagagtcaatctttgcttctttccttttttctctctctccttcccagtcccacccactctaatcccagctcctgtttgtccaagcccctcaagcaagactctctttagtgagtgaaagctgacaatgtgagtctcagcctccttcccaggagcagctaagctgacagatccttgatcttgagaagccctcgcagctcccttctctgactctcagccacccctggagggagacccctattatcaccattttacaagtgaggctcaggtgataacttgtccaaggccaggcagccagattgccgggaagcaggtgttcccagcgccgctgctttcaccctgttccacatctctggtccttgtgtttagaaccattcttgagtgggtttgccaaaggcaaaaagcaaaaccaaggcttggctgacagttactgaggccctctgaaatgtgcattggcaattccagaaacacaagctcagatcagatccttagcatttaaatgaacttatgtcaggtttgctacaatatgatctgctggaacagctttctaactccttaacgggatgaggtatattttccttggcctattctaggcaaagatcagcaacttcaaacaaggagctgttcttcaaataaattcctcattgatacacatttttgaagaacactgggaagtaaaaacctggaggactgaattgtgttgttgggcagatagttcttaagaaa

SEQ ID NO: 80318 - DNA, 534 bp, Homo sapiens
gatctcaagggtccagagctcaggagcttctgttcctgtgaagttggagtgtgccattctcctagcacatgggtgagttcttgtttaccttcatgtaatcctccatgagttcagctgtctggaggcttgcggtaccctgtcctcttgagtcttttttggagacttcattggataaacatgattgaagaatggacaatcgtatggaaatcttattggacaaaaagggcatgatctaatactaatagactgtgcagagaattgtaacaagtcctgtgcatttagattcttcttggcccctctgtgtagcattatttcctcctggataaggaaggggcaggaccccttcagaaatgcgggtcttatgacctgctgtcgggtaaggtaattcagaggatttttttatgaccagttccaagacagaaagatgggggaagattggagtatatttttagtgtgtgtggcctgccttggagagaaaaaggcgcaggtaaaaggaggacagaaggtcagagagagattctgttttctgaggcc

SEQ ID NO: 80319 - DNA, 793 bp, Homo sapiens
ggtgcgtcccccaacctgatgctagcccctttcctgttacttctcacccacagcaggagccccttgtctttcaggccatgcagccatgttccgggagccctaattgcacagaagcccatggggagctccagactggcagccctgctcctggcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccaggtatggtgt

SEQ ID NO: 80320 - DNA, 639 bp, Homo sapiens
tagggtgatatcactggttgatatgattagtgagatgaacattattaaggcaaattcttccgataattattgttatacaacatgattaatatatattcaatctgaaagagtcatatatacaaatatgaaataaacacctcaaatgagaagaagagagaaaacatggagaatgaagaaagttgggtgtattcttttcagtcttcccctcccatatctccgtctgaggccagcatggctaatattgagaaagagtaaggcaaatgagtaattattgtgctctgtcttttactgttattgaaggtcactgtttaacactccctcgccattcccctaaccactcccctttgccttaaattcattaagctgtattctttgtatttcctgataacagctgacaaggacccactctcatctgtaatgacaggtgagggtattgatgataagtagagttaataaagcttctccagtgatttagaattataacgctctgagtattatcatcaggggaatagatgaaaaagcccatttcattttgtgcagtgtccttcaaactgctggttatgaaatcattttagagggtctgtgaaatcactgtggaatacgatgaaacgtaatagaaagtatcagcagacactgtgg

SEQ ID NO: 80321 - DNA, 361 bp, Homo sapiens
ggtcgacctaacaaagcttgaaaacaaatcccaaaagggccaaactaaaccacaagtacctttctgcctgccactacaaaacacgacagtctttgaaggaagatgtaagatctagacactcaataatataaaactgacaatgttcagcatccaataaaaaatgactaaacaagtcaagaagcagaaatatgtgacccataaccagaaaaataatcactcaaaggaaacagacccagaaatgacagatacagaattagcagagaagaatattaaaacacctattataattattgttgactatttaaatgaaaacatgaacaaagtgaggaaagaaattgaaggcattaaaaaaaagtcgacg

SEQ ID NO: 80322 - DNA, 644 bp, Homo sapiens
gccagagatgatggtgtcttggaccaagaccaattatgaagggcgtgagagcaggtgcattttggacttattgaagatagtgtgtgagatttcctgacagattggatgtgtaaatgaaagaaaaaaaaagaactattttgattcttgttgttttgttttggtttttattttttaacccaggcaactaccattagtcaagaatgaagtctacaggtggacaggattttgggggatgattagaagctcaacttgtggtatcctgaggttaagatatttattaaaataaaatcagctaagtaagatcccagtatctgcctcatggaagatgttacaagttattgcacaaatattatatatatataatctctctcaatatattaagtacccctagagtatgaatgaattaatgaataagtattcattgagcagatggtactcaatgaacgacagacaccatgctgtgccctgtcaagtagatggcttaacagaatccatgttagagcttcatcaggtaaatggtattgtctacatctcacagaagaagaaactcaggacaagtaacttgactgaagttcacatggttagtaagtagttctaactttaagattgaaactcatttttccacaacttcaaataaaacccct

SEQ ID NO: 80323 - DNA, 598 bp, Homo sapiens
cagcgaaggtctgcagcttcactcctgaagccagcgagaccacgaacccaccgggagaaacgaacaactccagacgcatcactttaagaactgtgacgctcaccgcgaaggtttgcaacttcactcctgagccaccgagaccacgaacccaccggaaggaagaaactccgaacacatccgaacatcagaaggaacaaactccagacacgccgcctttaagaactgtaacactcaccgcgagggtccgcggtttattcttgaggtcagtgagaccaagaacccaccaattctggacacaccaccttgcccttctacttttcacaggtactaaggtctcaaactcataagtttttccagggttttctgcattgaacaactttttgtttgtttggtggtggtagtgaggaatagaccttccccctttgaaagcttcccttgtttcctttagtctgataaatcagttaccacttaaatatctgcttcctagcttctgaactcatgctgataatgcccatctgctgtctttacatgcctggtgtctctgatggccatttttcttaggggcttgttcagtgcaaataaatgactctctatggaa

SEQ ID NO: 80324 - DNA, 801 bp, Homo sapiens
tgagtgacccagtagtgaccgggatagaggtctgagcctggaaaggcagctgtgagggggtggaagagactgagcacatagtggctcatcgcggtcacggacttccagacgcgctcgcgcttgctgcgctccgggctcagtccccgcgggcttgcgcaccagatcgtgcgccacgacgacctcctgctgggcgactaccgcctgcacctgcgccgctccctggtccggcggcgcatgctcgaggccctgggggcggagccgaacgaggaggcctgacgcccgggcgggccccggcagcgcttgcgcaccgccccgcgggctggggccacccacccggagccccggaggacagggggcgttgccttcccaggaaggaggcggggccggctcgagggggtggatactgtgagtttaattataaagaatgacctggtacaaaagccatttctctctgcaaaatcttggtggggagtcaggggaagggaggtgatggggggtaggaatgaacccccatgttataatcccgcgtccctaatcttcctccagtccctgtacgtggacgcctgggtcccaatcccttgagggatgaactgaagcccgcgaaagggaagacctgggcaccggggctttcagcgcgtgccgagccctgtctcagcgagaatcagacgtcctcatccgcccccctcctcttcccctcccacccccccttggaagacaattctcgggcttttatttcaggttttttttctggatttttttgtgtgttctaggggttttgtgttttttttttctgttttttat

SEQ ID NO: 80325 - DNA, 794 bp, Homo sapiens
agagcgggcgcgtgagcagcatccgctttgagaacatgaacgtcatctgtgggactgctgggcgccggaaccggtggctcatcgcggtcacggacttccagacgcgctcgcgcttgctgcgctccgggctcagtccccgcgggcttgcgcaccagatcgtgcgccacgacgacctcctgctgggcgactaccgcctgcacctgcgccgctccctggtccggcggcgcatgctcgaggccctgggggcggagccgaacgaggaggcctgacgcccgggcgggccccggcagcgcttgcgcaccgccccgcgggctggggccacccacccggagccccggaggacagggggcgttgccttcccaggaaggaggcggggccggctcgagggggtggatactgtgagtttaattataaagaatgacctggtacaaaagccatttctctctgcaaaatcttggtggggagtcaggggaagggaggtgatggggggtaggaatgaacccccatgttataatcccgcgtccctaatcttcctccagtccctgtacgtggacgcctgggtcccaatcccttgagggatgaactgaagcccgcgaaagggaagacctgggcaccggggctttcagcgcgtgccgagccctgtctcagcgagaatcagacgtcctcatccgcccccctcctcttcccctcccacccccccttggaagacaattctcgggcttttatttcaggttttttttctggatttttttgtgtgttctaggggttttgtgttttttttttctgttttttat

SEQ ID NO: 80326 - DNA, 422 bp, Homo sapiens
agtaggggcccgagtttgagtgacccagtagtgaccgggatagaggtctgagcctggaaaggcagctgtgagggggtggaagagactgagcacatagtaggtgtggggccaggggtgatagggtggggacaggcctggagtgcctagggtagagcgcagcctgcagtcgccagtggagggtcgggcctttgggcggtttgagatggagcctcgacagacagtgattaggacgcagaaccaggctaagagagcgtaaggagcctagagcgacccaggcgagagggcagggctggaggggagtttagggacggagcgatggtccgctggaccagggcctgtaaacgactccagggaccaggcagggactcttcgacgatcaaagccagggctgaaacgacctgcgagttccttttccgtcccca

SEQ ID NO: 80327 - DNA, 465 bp, Homo sapiens
  misc_feature (114)..(114): n is a, c, g, or t
  misc_feature (116)..(116): n is a, c, g, or t
  misc_feature (399)..(399): n is a, c, g, or t
  misc_feature (415)..(415): n is a, c, g, or t
  misc_feature (465)..(465): n is a, c, g, or t
atagagacctctactgggcatatctatgctaggttttctcagacttctcagtcactatgtctcattaactttttaatcttataagaattcctcgatttctgaactgcggatagnantagtgttctttttttttttccagccgagttaaggatttcttactcacttaatggtaacaatagtagcaataccacctgccactaataatagtgatttaaaagggattataggcagaaatgtaagtagatatgtctgttcagactgctgtctgtcttgaaacaaggttatcttttcaatactcatagcttttagcctttagcttttagtcttattatttgctaggaacacattctgattttggacagcttctaacattttttgcagatgcatgtctgccttttnggaaagcgtgggatgnaaagccaatggcaacctttggggggaaattggtgtagggtgggattttgn

SEQ ID NO: 80328 - DNA, 941 bp, Homo sapiens
ctcccaccttcaaagttcatatctaagaaaacccctactaaatcctttagaatggaactgctcaatatagtagccactagccacattgactactgagtacttaaatgtgactagtgcaactgaggaactgaatttttaattttatttaactgtaactaattttaattgaaaaactgatactctattcaattactggaaaacttttaagtacatttggaccaacctggactcgtgaatttacttttgttcccagtgtttttttctatttttttattgataacataatagatatacatattttgagtgtgtattcaaacatttaatattaatacattcatataatttgtaaagatcaaatcagtgtaactgggatatccattaccttaaatgaatctactttttaaatggtatttataaaatctaaatatatgtgaagtgtttctgcttaaatttagtgtttgaattgagatgtgctccaagtgtacaacacacaccaaatttcaaagacttagttaaaaaaaaaacactgggaagggcaggaggaagggagagatagggagagatttgttaaaggatataaaattatagctagataggaggaataggttctagtgtagtatggccatagttaacaataatatatagcttcaaagagctagaaggaggatattgaatgtttccaacataagcatcaatatttgagattatagatatgctaattacagtgttctgatcactatacattgtatattgaaacatcaatatgtaccccatgaatatgtacaattattacatgaatatgtatcaaaacaaattaaatttaaagacaaaacaaagaacataaaacatcttcttaataatgttttatattatgtgttgaaatgataacatcttgtatatattgggtaaagtaaaatatatcattaagataaattttacct

SEQ ID NO: 80329 - DNA, 531 bp, Homo sapiens
acatgagaaaatgagaagaaaatggttttttgatcagactgggacagaatttaagacattaagcctaggctaacaagatacttagaccagtggtttaagatgtaggcatgataccttagctgcaattgcatgagtagctaagaccacacacttgggaccagagacgacctgcctatcacatcagctccccagcttccttcccacacacaggggagtaactcctctgtcaaagcccactagagagatcccagagcctccctgggaatcattttactgtttgacaattatatctgccagaaagtacctcttgtgctgccaaagagaccattttcactattgtgcttcattctttagtcgtgaggatgcagcatctttaacaaaggaagctattgattggctgcagttcaagcttttattacctttttttaagactaccattttcttttttaaagtaaaaatactcattgggtcgccatactgagtaatttgacattgaaaaccattttataaatacagcctcctcagagtaaa

SEQ ID NO: 80330 - DNA, 597 bp, Homo sapiens
ttttcctgttagaatgacttgctagtctacttcttgtaagaaccatcaaaaccctaagcatgtatactaggatacttagatctactggtatattgttacaatgtaagtcaaagagcagatattaaaagtcttaaagcactatgagattgcttgtaaaatagccagatgtgtctgttacctaaatatttttgtttaaactggatcttaatctgttttctttgaggtaaaattatctttatagatgcatttttctgtatttgtgttgatacaatttagaccatgtcttgtatgtaatattcctgatactactgaacccttaatatactttcagtaaatactagttacagtttgtcatgcattttttcattgtttcaccttttcctgccttagagttaatgtttttggagctagaatgtccttaggaatgatacagtagaatttctgcattttatagatgagaatgagactgtgacttgtttagaattgttctttttctgcagatgtagatttgaaaggaaataacaattctaatgctactgtccatcgaagtataaagcgttgagaagtataaagcgttgaggaagtataaagcgttga

SEQ ID NO: 80331 - DNA, 560 bp, Homo sapiens
cacactgaatccagcaatataaaatataatatatatatatttaaagccaaagatgtattaaagccaaggatgtattatagccaaggtgcaattatactagaaattcaaagttggtttaacattagaaaatcaaccaatatatttcacccacaccaacactttaaagaagaaaaactgagtggtcttttccatagaaaaatgtaattgataaaattcaccatccattcattttattttatttacttatttatctttttttctggagacggtgtttcactctgtcgcccaggctggagagcagtggcgtgatctcagctcactgtaacatccgcctcccaagttcaagcgattctcctgactcagcctccagtgtagctgggattataggcatgcgccaccacacacagctaattttgtatttttagtagagacggggtttcaccatgttggtcagggtggtgtcgatctcctgacttcaggtgatccacctgcctcggcctcccaaagtgtgtgagccagcttgcctggcctcaccatccattcatgatttaaaaaaaaaa

SEQ ID NO: 80332 - DNA, 1571 bp, Homo sapiens
gtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcgcggggattactttgctgctagtttcggttcgcggcaggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaa

SEQ ID NO: 80333 - DNA, 1085 bp, Homo sapiens
gaattcgaggatccgggtaccatggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttca

SEQ ID NO: 80334 - DNA, 319 bp, Homo sapiens
gcggccgctactactactaaattcgcggccgctcgaccgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttca

SEQ ID NO: 80335 - DNA, 810 bp, Homo sapiens
agaaaaaaaaaaaaaaaaaaaaaaaaaaaaaacagaactaatttaaatcttgaaccctacgtaccgagtgccctcccggtggttatcgtgcacaggcgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgg

SEQ ID NO: 80336 - DNA, 1072 bp, Homo sapiens
ggctcggcacctcatgctttatacttcccgcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaa

SEQ ID NO: 80337 - DNA, 1219 bp, Homo sapiens
ggctcggcacctcatgctttatacttcccgcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaa

SEQ ID NO: 80338 - DNA, 1276 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaa

SEQ ID NO: 80339 - DNA, 1641 bp, Homo sapiens
tgggttagcgatggaggtaggattggtgctgtgggtgaaagagtatgatggggtggtggttgtggtaaactttaatagtgtaggaagctgaataatttatgaaggagaggggtcaggcttgattcgggaggatcctattggtgcgggggctttgtatgattatgggcgttgattagtagtgtgttacgtgttctgatcagttaataatataaaatattaacatatggatagtttgatacaatgagtttgcctatttgtggttccccattttgatagtataggaaggaagaatagttcttgccccaatacgttttatgaagatagaggtaggttcaggaattatttcctgaataatttgtgttccaggctctgctaaattttgaaattaactttaaagatactatagacttaaagatgcctagttaaaaggatgtgttttagcaattcacagaagtccatattttgaaattttgttaggcaagcaacttttaactgaatcattattttgatcctgggctaaagggaagtagcagttatgtttgtatatagtgctaaagggaagtagcagtcatgtttgtatatattgaaggtaatggttatctagtaattggttaaatttgtgtatgtcctaccattcttacctttagatttaaacagtatatgttagttgatgttacatcaccaccatgacttgacagtttaatcttgagcaagtcaacatatgcttggcattatctgtatttatagttatttttaagtaagttaatagtctctgaacttcagttaagatatatattttttaaatgaaaacttcaatttccttaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaa

SEQ ID NO: 80340 - DNA, 1788 bp, Homo sapiens
tgggttagcgatggaggtaggattggtgctgtgggtgaaagagtatgatggggtggtggttgtggtaaactttaatagtgtaggaagctgaataatttatgaaggagaggggtcaggcttgattcgggaggatcctattggtgcgggggctttgtatgattatgggcgttgattagtagtgtgttacgtgttctgatcagttaataatataaaatattaacatatggatagtttgatacaatgagtttgcctatttgtggttccccattttgatagtataggaaggaagaatagttcttgccccaatacgttttatgaagatagaggtaggttcaggaattatttcctgaataatttgtgttccaggctctgctaaattttgaaattaactttaaagatactatagacttaaagatgcctagttaaaaggatgtgttttagcaattcacagaagtccatattttgaaattttgttaggcaagcaacttttaactgaatcattattttgatcctgggctaaagggaagtagcagttatgtttgtatatagtgctaaagggaagtagcagtcatgtttgtatatattgaaggtaatggttatctagtaattggttaaatttgtgtatgtcctaccattcttacctttagatttaaacagtatatgttagttgatgttacatcaccaccatgacttgacagtttaatcttgagcaagtcaacatatgcttggcattatctgtatttatagttatttttaagtaagttaatagtctctgaacttcagttaagatatatattttttaaatgaaaacttcaatttccttaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaa

SEQ ID NO: 80341 - DNA, 2425 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtatgttctaaaaatagtttttttttgtcatttacaatagtagtttttataatctatattgttcataaaacaatgcttaatttaagagtttcacagcacccagaagtgcttaccatattataacatagtgactttcaaagatatgtaacacaggtgctcttaagcttttgcctttttgtcctattattaacaagtcagtaaagttaacaggtaaagtactgctaatgggtacaaattaaggaattgcagcaaaaaagtattgcctactaactctgacattataccttgtttgtacccgccagcgggaacttcattgcaggccctgtgtcgcgctgacttcacgattctcacaggcccgctcaatgcggacagggtacgagatgctcacgctctcgaatgctgccgtttggtatggtctcttccaacatcctgtatcagcattataaaataaaatggatacttcaagctttgccttcacttatttctttgctttttaaaaactatttgtaatgtaattttaatgcattttttacaggcccagtaatggttaaatacgtcagcttactgaataattttaactatttattcttctaaggatacagcttgtctctggattttccagtcttaattttatattttattaatctattttaatgcttgcttttcccatttatagacgttgtagcagtaattgcaagaagttcttgagctgaattcctgttgtgacaacttcctataattacagtagataactttttcttttagtcgtatataacttttctataacttgtgatggacaagagatatgcttatccaataaaataagcttaaatattagatgctcttgggtcaaaatgtccttttaccaaattgacctttttatgagttctttgggtaaatactttaaagctttttatattttaaagaatacttgtaaaagcatatcacatcttaaaccagtggtgcacatgtggatttacagctcatggactctactgttcagctttaatttataaaacatatcacacatttaatgttatacagtatttacatatagtggaacatagggataactcagttttatgtaaatttttgttaagtgttgtagcctgcccagagtgacttctattttttcttctttgtctccaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaa

SEQ ID NO: 80342 - DNA, 1422 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaatttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaa

SEQ ID NO: 80343 - DNA, 1516 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaaaaaaaaaaaaaaaaaaaaaaaaaaaaaaaaaaaaaaaaaaaaaaaaaaaaaaaaaaaaaaaaaaaaaagggaaaaaaaaaaaacccaaaaaaaaaaaaaaccttgtcgcccgcttgggcccagtcgattttaaactcgaccaagtttatccttgcggccgaatttcggcctcattggcccaattccccctatagggagccgttttacaattcattgcccgccgtttaacaacgtcgga

SEQ ID NO: 80344 - DNA, 2916 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggattaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgcttatttgtttgaatgattttattttccatttctcaaaggttttatttttttggttagggccttaaaatttcaggactgtgattattagtatgtgtgcctaaggaactttttgagtcactcttaagaaagtgaaactgaagagtctaagtgataactataggattaagtcagaattgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgatggaatacctttcttacttttgtggagttacatctgatgctaagaatttgacctccaactaagcaaacattttaatgagcaaaagttagtgttattaaagttttttatgatagatccaaattgaggacctgtgtcctgtttttataagattgcaacccagctatgctcatttgtttatgttttgtatatggctgcttttgtgttacagtggtagagtttagtagttaggacagagacctgcaaagcaaaataatttacagtctggccctttacagaaaagtttgctgactcatggtcaaaataaatgaaaattttttgtgttagggttgttaagctagggttctttttggtatcatatgcttattttatgtaaatctctcaataaaaaattatttttaagagaaaaaaaaaaaaaaaaaaaaaaaaaaaaaaaaaggggggggggtaaaaatttccctgggggggcccaggttaggggtcccggtttttgttaaggggggcccctattggggggcccgattttaaaccgcaagggaccggggccgggcggttaacccacggtccgggcctgtggacaccctggcgttccctggggaccctgtggggaggggaccccttactttcttggggtgggccttatctgtgcgcgacttacctacggggagttaaggcacccggcgggaattttaacattttcaggtctttctgctgtgatccaacgctggatatgtctcgcggtggaaagtttcggtcacgggttgctttagacatttttcccagcggc

SEQ ID NO: 80345 - DNA, 2752 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgcttatttgtttgaatgattttattttccatttctcaaaggttttatttttttggttagggccttaaaatttcaggactgtgattattagtatgtgtgcctaaggaactttttgagtcactcttaagaaagtgaaactgaagagtctaagtgataactataggattaagtcagaattgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgatggaatacctttcttacttttgtggagttacatctgatgctaagaatttgacctccaactaagcaaacattttaatgagcaaaagttagtgttattaaagttttttatgatagatccaaattgaggacctgtgtcctgtttttataagattgcaacccagctatgctcatttgtttatgttttgtatatggctgcttttgtgttacagtggtagagtttagtagttaggacagagacctgcaaagcaaaataatttacagtctggccctttacagaaaagtttgctgactcatggtcaaaataaatgaaaattttttgtgttagggttgttaagctagggttctttttggtatcatatgcttattttatgtaaatctctcaataaaaaattatttttaagagaaaaaaaaaaaaaaaaaaaaaaaaaaaaaaaaaggggggggggtaaaaatttccctgggggggcccaggttaggggtcccggtttttgttaaggggggcccctattggggggcccgattttaaaccgcaagggaccggggccgggcggttaacccacggtccgggcctgtggacaccctggcgttccctggggaccctgtggggaggggaccccttactttcttggggtgggccttatctgtgcgcgacttacctacggggagttaaggcacccggcgggaattttaacattttcaggtctttctgctgtgatccaacgctggatatgtctcgcggtggaaagtttcggtcacgggttgctttagacatttttcccagcggc

SEQ ID NO: 80346 - DNA, 1220 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcctgtaggggactcctctagacgccacc

SEQ ID NO: 80347 - DNA, 4018 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatttaataatgtaatttttctcttttagtgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtatgttctaaaaatagtttttttttgtcatttacaatagtagtttttataatctatattgttcataaaacaatgcttaatttaagagtttcacagcacccagaagtgcttaccatattataacatagtgactttcaaagatatgtaacacaggtgctcttaagcttttgcctttttgtcctattattaacaagtcagtaaagttaacaggtaaagtactgctaatgggtacaaattaaggaattgcagcaaaaaagtattgcctactaactctgacattataccttgtttgtacccgccagcgggaacttcattgcaggccctgtgtcgcgctgacttcacgattctcacaggcccgctcaatgcggacagggtacgagatgctcacgctctcgaatgctgccgtttggtatggtctcttccaacatcctgtatcagcattataaaataaaatggatacttcaagctttgccttcacttatttctttgctttttaaaaactatttgtaatgtaattttaatgcattttttacaggcccagtaatggttaaatacgtcagcttactgaataattttaactatttattcttctaaggatacagcttgtctctggattttccagtcttaattttatattttattaatctattttaatgcttgcttttcccatttatagacgttgtagcagtaattgcaagaagttcttgagctgaattcctgttgtgacaacttcctataattacagtagataactttttcttttagtcgtatataacttttctataacttgtgatggacaagagatatgcttatccaataaaataagcttaaatattagatgctcttgggtcaaaatgtccttttaccaaattgacctttttatgagttctttgggtaaatactttaaagctttttatattttaaagaatacttgtaaaagcatatcacatcttaaaccagtggtgcacatgtggatttacagctcatggactctactgttcagctttaatttataaaacatatcacacatttaatgttatacagtatttacatatagtggaacatagggataactcagttttatgtaaatttttgttaagtgttgtagcctgcccagagtgacttctattttttcttctttgtctccaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgcttatttgtttgaatgattttattttccatttctcaaaggttttatttttttggttagggccttaaaatttcaggactgtgattattagtatgtgtgcctaaggaactttttgagtcactcttaagaaagtgaaactgaagagtctaagtgataactataggattaagtcagaattgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgatggaatacctttcttacttttgtggagttacatctgatgctaagaatttgacctccaactaagcaaacattttaatgagcaaaagttagtgttattaaagttttttatgatagatccaaattgaggacctgtgtcctgtttttataagattgcaacccagctatgctcatttgtttatgttttgtatatggctgcttttgtgttacagtggtagagtttagtagttaggacagagacctgcaaagcaaaataatttacagtctggccctttacagaaaagtttgctgactcatggtcaaaataaatgaaaattttttgtgttagggttgttaagctagggttctttttggtatcatatgcttattttatgtaaatctctcaataaaaaattatttttaagagaaaaaaaaaaaaaaaaaaaaaaaaaaaaaaaaaggggggggggtaaaaatttccctgggggggcccaggttaggggtcccggtttttgttaaggggggcccctattggggggcccgattttaaaccgcaagggaccggggccgggcggttaacccacggtccgggcctgtggacaccctggcgttccctggggaccctgtggggaggggaccccttactttcttggggtgggccttatctgtgcgcgacttacctacggggagttaaggcacccggcgggaattttaacattttcaggtctttctgctgtgatccaacgctggatatgtctcgcggtggaaagtttcggtcacgggttgctttagacatttttcccagcggc

SEQ ID NO: 80348 - DNA, 2269 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtatgttctaaaaatagtttttttttgtcatttacaatagtagtttttataatctatattgttcataaaacaatgcttaatttaagagtttcacagcacccagaagtgcttaccatattataacatagtgactttcaaagatatgtaacacaggtgctcttaagcttttgcctttttgtcctattattaacaagtcagtaaagttaacaggtaaagtactgctaatgggtacaaattaaggaattgcagcaaaaaagtattgcctactaactctgacattataccttgtttgtacccgccagcgggaacttcattgcaggccctgtgtcgcgctgacttcacgattctcacaggcccgctcaatgcggacagggtacgagatgctcacgctctcgaatgctgccgtttggtatggtctcttccaacatcctgtatcagcattataaaataaaatggatacttcaagctttgccttcacttatttctttgctttttaaaaactatttgtaatgtaattttaatgcattttttacaggcccagtaatggttaaatacgtcagcttactgaataattttaactatttattcttctaaggatacagcttgtctctggattttccagtcttaattttatattttattaatctattttaatgcttgcttttcccatttatagacgttgtagcagtaattgcaagaagttcttgagctgaattcctgttgtgacaacttcctataattacagtagataactttttcttttagtcgtatataacttttctataacttgtgatggacaagagatatgcttatccaataaaataagcttaaatattagatgctcttgggtcaaaatgtccttttaccaaattgacctttttatgagttctttgggtaaatactttaaagctttttatattttaaagaatacttgtaaaagcatatcacatcttaaaccagtggtgcacatgtggatttacagctcatggactctactgttcagctttaatttataaaacatatcacacatttaatgttatacagtatttacatatagtggaacatagggataactcagttttatgtaaatttttgttaagtgttgtagcctgcccagagtgacttctattttttcttctttgtctccaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttca

SEQ ID NO: 80349 - DNA, 1186 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctatgccctttcccccagtattgtagagcaagtcttgtgttaaaagcccagtgtgacagtgtcatgatgtagtagtgtcttactggttttttaataaatccttttgtataaa

SEQ ID NO: 80350 - DNA, 1383 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacagcgggaacttcattgcaggccctgtgtcgcgctgacttcacgattctcacaggcccgctcaatgcggacagggtacgagatgctcacgctctcgaatgctgccgtttggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaa

SEQ ID NO: 80351 - DNA, 1236 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacagcgggaacttcattgcaggccctgtgtcgcgctgacttcacgattctcacaggcccgctcaatgcggacagggtacgagatgctcacgctctcgaatgctgccgtttggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaa

SEQ ID NO: 80352 - DNA, 1501 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacagggtgaacgccgtacttttccacatttgaagattccatttgacacgtggctccgtggccacctggctacaatacgccgttcacacctaacattcaaggtactcacggtccctgacatgcgcagttattggacgtcgggtacctctgcagctacactcctgaagtactcactaacacgacactatggcatcattggcctacattactaacttgtaaagcaacacgaagccaaactggcgatacatgaacaacccccccagtcttgtaccacaagaccgtggcgtcaacgtccaacaggacacggcaaacagcccacacgcgaccccgagcaccaacaaaccgttaggtaacacaaaactaaaccaacacaaacaccaaaagcagccaaacaacagcgcacacaaaaacacggggagccccagcaacgcatagacgccccgaacctataaccaagcacgaagcaaaaaagagaaacgctaacagcatacggagaagtaaaccaccagccaaaagataagccaacaccacgatcgcacgaggacacgacgaac

SEQ ID NO: 80353 - DNA, 1047 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacagggtgaagcagtattttccactttgaagattcattgaattctgctgtgctttcagggtggttttggttgaaagctttgccaagtgatagatcagaaacatcaatgggcccatttagaagttcagagagtgaatggcttaaagtagcaggtgagggcatgctgttgctgatactgggctcagctatgaaagcagaataaaattcatcaccaaaatctgtgttgactgtgcggtaagtatgtagt

SEQ ID NO: 80354 - DNA, 841 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatgggaatttaccgaaacccgtggaagcctttaaggaatggaaagagtggataataaaatgcctggctgttctccaaaaatgaggaccttcaaataggagtgattgaaataaataactacttgcatgttatgctttcatttgggtggaatacttcattggaataaactactgatcttgtgctgtgtcaaagtaacagactagaaccttctttcaagtacctgaattgaaatgaaactcattttgaataataaaaactctagaaactcaaa

SEQ ID NO: 80355 - DNA, 683 bp, Homo sapiens
gtgaaataaaagtagccatgtcgaaggaacaatatcagcaacagcaacagtggggatctagaggaggatttgcaggaagagctcgtggaagaggtggtggtaagctagagcctaagtttactctatcttaagcttttctgctttttaattatcctgaagtaaagatctttgctgatcttctgactttagtgaacctattaatgtgctgcaggccccagtcaaaactggaaccagggatatagtaactattggaatcaaggctatggcaactatggatataacagccaaggttacggtggttatggaggatatgactacactggttacaacaactactatggatatggtgattatagcagtaagtactatactttttatattaactgctatttgacatttattttgtacaaatttggataggcagaaaggttagtgtagccttgccaagtgcaaatgtcttcaggtttcaaattcctggaaacttgaaactgcagccattttattgcttggttcctcccagcctatatcacacacacattataagggtagggtgtatgtgtggttctatatatgtttgctgggcatttgttttacttggatttaaaaattttaagctcagttcagatcttttaagctcaaggtattctaaatgtcacttcttggaccaaccaataatcttggca

SEQ ID NO: 80356 - DNA, 678 bp, Homo sapiens
gtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcgcggggattactttgctgctagtttcggttcgcggcaggcgggtgtagtctcggcggcagcggcggagacactagcactatgtcggaggagcagttcggcggggacggggcggcggcagcggcaacggcggcggtaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaa

SEQ ID NO: 80357 - DNA, 1718 bp, Homo sapiens
gtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcgcggggattactttgctgctagtttcggttcgcggcaggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaa

SEQ ID NO: 80358 - DNA, 657 bp, Homo sapiens
atacgctaggtgcgaggctgggttagggacacagagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaa

SEQ ID NO: 80359 - DNA, 1129 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaa

SEQ ID NO: 80360 - DNA, 2989 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgcttatttgtttgaatgattttattttccatttctcaaaggttttatttttttggttagggccttaaaatttcaggactgtgattattagtatgtgtgcctaaggaactttttgagtcactcttaagaaagtgaaactgaagagtctaagtgataactataggattaagtcagaattgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgatggaatacctttcttacttttgtggagttacatctgatgctaagaatttgacctccaactaagcaaacattttaatgagcaaaagttagtgttattaaagttttttatgatagatccaaattgaggacctgtgtcctgtttttataagattgcaacccagctatgctcatttgtttatgttttgtatatggctgcttttgtgttacagtggtagagtttagtagttaggacagagacctgcaaagcaaaataatttacagtctggccctttacagaaaagtttgctgactcatggtcaaaataaatgaaaattttttgtgttagggttgttaagctagggttctttttggtatcatatgcttattttatgtaaatctctcaataaaaaattatttttaagagaaaaaaaaaaaaaaaaaaaaaaaaaaaaaaaaaggggggggggtaaaaatttccctgggggggcccaggttaggggtcccggtttttgttaaggggggcccctattggggggcccgattttaaaccgcaagggaccggggccgggcggttaacccacggtccgggcctgtggacaccctggcgttccctggggaccctgtggggaggggaccccttactttcttggggtgggccttatctgtgcgcgacttacctacggggagttaaggcacccggcgggaattttaacattttcaggtctttctgctgtgatccaacgctggatatgtctcgcggtggaaagtttcggtcacgggttgctttagacatttttcccagcggc

SEQ ID NO: 80361 - DNA, 2842 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgcttatttgtttgaatgattttattttccatttctcaaaggttttatttttttggttagggccttaaaatttcaggactgtgattattagtatgtgtgcctaaggaactttttgagtcactcttaagaaagtgaaactgaagagtctaagtgataactataggattaagtcagaattgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgatggaatacctttcttacttttgtggagttacatctgatgctaagaatttgacctccaactaagcaaacattttaatgagcaaaagttagtgttattaaagttttttatgatagatccaaattgaggacctgtgtcctgtttttataagattgcaacccagctatgctcatttgtttatgttttgtatatggctgcttttgtgttacagtggtagagtttagtagttaggacagagacctgcaaagcaaaataatttacagtctggccctttacagaaaagtttgctgactcatggtcaaaataaatgaaaattttttgtgttagggttgttaagctagggttctttttggtatcatatgcttattttatgtaaatctctcaataaaaaattatttttaagagaaaaaaaaaaaaaaaaaaaaaaaaaaaaaaaaaggggggggggtaaaaatttccctgggggggcccaggttaggggtcccggtttttgttaaggggggcccctattggggggcccgattttaaaccgcaagggaccggggccgggcggttaacccacggtccgggcctgtggacaccctggcgttccctggggaccctgtggggaggggaccccttactttcttggggtgggccttatctgtgcgcgacttacctacggggagttaaggcacccggcgggaattttaacattttcaggtctttctgctgtgatccaacgctggatatgtctcgcggtggaaagtttcggtcacgggttgctttagacatttttcccagcggc

SEQ ID NO: 80362 - DNA, 4138 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtatgttctaaaaatagtttttttttgtcatttacaatagtagtttttataatctatattgttcataaaacaatgcttaatttaagagtttcacagcacccagaagtgcttaccatattataacatagtgactttcaaagatatgtaacacaggtgctcttaagcttttgcctttttgtcctattattaacaagtcagtaaagttaacaggtaaagtactgctaatgggtacaaattaaggaattgcagcaaaaaagtattgcctactaactctgacattataccttgtttgtacccgccagcgggaacttcattgcaggccctgtgtcgcgctgacttcacgattctcacaggcccgctcaatgcggacagggtacgagatgctcacgctctcgaatgctgccgtttggtatggtctcttccaacatcctgtatcagcattataaaataaaatggatacttcaagctttgccttcacttatttctttgctttttaaaaactatttgtaatgtaattttaatgcattttttacaggcccagtaatggttaaatacgtcagcttactgaataattttaactatttattcttctaaggatacagcttgtctctggattttccagtcttaattttatattttattaatctattttaatgcttgcttttcccatttatagacgttgtagcagtaattgcaagaagttcttgagctgaattcctgttgtgacaacttcctataattacagtagataactttttcttttagtcgtatataacttttctataacttgtgatggacaagagatatgcttatccaataaaataagcttaaatattagatgctcttgggtcaaaatgtccttttaccaaattgacctttttatgagttctttgggtaaatactttaaagctttttatattttaaagaatacttgtaaaagcatatcacatcttaaaccagtggtgcacatgtggatttacagctcatggactctactgttcagctttaatttataaaacatatcacacatttaatgttatacagtatttacatatagtggaacatagggataactcagttttatgtaaatttttgttaagtgttgtagcctgcccagagtgacttctattttttcttctttgtctccaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgcttatttgtttgaatgattttattttccatttctcaaaggttttatttttttggttagggccttaaaatttcaggactgtgattattagtatgtgtgcctaaggaactttttgagtcactcttaagaaagtgaaactgaagagtctaagtgataactataggattaagtcagaattgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgatggaatacctttcttacttttgtggagttacatctgatgctaagaatttgacctccaactaagcaaacattttaatgagcaaaagttagtgttattaaagttttttatgatagatccaaattgaggacctgtgtcctgtttttataagattgcaacccagctatgctcatttgtttatgttttgtatatggctgcttttgtgttacagtggtagagtttagtagttaggacagagacctgcaaagcaaaataatttacagtctggccctttacagaaaagtttgctgactcatggtcaaaataaatgaaaattttttgtgttagggttgttaagctagggttctttttggtatcatatgcttattttatgtaaatctctcaataaaaaattatttttaagagaaaaaaaaaaaaaaaaaaaaaaaaaaaaaaaaaggggggggggtaaaaatttccctgggggggcccaggttaggggtcccggtttttgttaaggggggcccctattggggggcccgattttaaaccgcaagggaccggggccgggcggttaacccacggtccgggcctgtggacaccctggcgttccctggggaccctgtggggaggggaccccttactttcttggggtgggccttatctgtgcgcgacttacctacggggagttaaggcacccggcgggaattttaacattttcaggtctttctgctgtgatccaacgctggatatgtctcgcggtggaaagtttcggtcacgggttgctttagacatttttcccagcggc

SEQ ID NO: 80363 - DNA, 1706 bp, Homo sapiens
  misc_feature (1324)..(1324): n is a, c, g, or t
  misc_feature (1334)..(1334): n is a, c, g, or t
  misc_feature (1336)..(1336): n is a, c, g, or t
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaaaaaaaaaaaaaaaaaaaaaaaaaaaaaaaagaaaaaaaaaaaaaanaaaaaaaaananaaaaaaaaagaaaaagagaaaaaaagaaaagagagaaagggagggggaaaaaagagacggggcgaggcaaaaaagagggggggggggagaagaaaacaaggggcaacaacacaacgaacacgtaagcaacgaccacgcgacgagacagccgatagaaaacaaggacgaggcttcgtacaaaacaggcaggcagagacaaaagaagaaaaccacgctagatccgcgcgtccaaccacacgaagcaagcaacacacacacgacacaagtagcagcacatgaaaaacaaaaccccaccgaagagggagacacccgcgacatagcagacgggcacaaaaggccacacactagtcagtcagacaccaaggacacc

SEQ ID NO: 80364 - DNA, 2958 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgcttatttgtttgaatgattttattttccatttctcaaaggttttatttttttggttagggccttaaaatttcaggactgtgattattagtatgtgtgcctaaggaactttttgagtcactcttaagaaagtgaaactgaagagtctaagtgataactataggattaagtcagaattgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgatggaatacctttcttacttttgtggagttacatctgatgctaagaatttgacctccaactaagcaaacattttaatgagcaaaagttagtgttattaaagttttttatgatagatccaaattgaggacctgtgtcctgtttttataagattgcaacccagctatgctcatttgtttatgttttgtatatggctgcttttgtgttacagtggtagagtttagtagttaggacagagacctgcaaagcaaaataatttacagtctggccctttacagaaaagtttgctgactcatggtcaaaataaatgaaaattttttgtgttagggttgttaagctagggttctttttggtatcatatgcttattttatgtaaatctctcaataaaaaattatttttaagagaaaaaaaaaaaaaaaaaaaaaaaaaaaaaaaaaggggggggggtaaaaatttccctgggggggcccaggttaggggtcccggtttttgttaaggggggcccctattggggggcccgattttaaaccgcaagggaccggggccgggcggttaacccacggtccgggcctgtggacaccctggcgttccctggggaccctgtggggaggggaccccttactttcttggggtgggccttatctgtgcgcgacttacctacggggagttaaggcacccggcgggaattttaacattttcaggtctttctgctgtgatccaacgctggatatgtctcgcggtggaaagtttcggtcacgggttgctttagacatttttcccagcggc

SEQ ID NO: 80365 - DNA, 1559 bp, Homo sapiens
  misc_feature (1177)..(1177): n is a, c, g, or t
  misc_feature (1187)..(1187): n is a, c, g, or t
  misc_feature (1189)..(1189): n is a, c, g, or t
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaaaaaaaaaaaaaaaaaaaaaaaaaaaaaaaagaaaaaaaaaaaaaanaaaaaaaaananaaaaaaaaagaaaaagagaaaaaaagaaaagagagaaagggagggggaaaaaagagacggggcgaggcaaaaaagagggggggggggagaagaaaacaaggggcaacaacacaacgaacacgtaagcaacgaccacgcgacgagacagccgatagaaaacaaggacgaggcttcgtacaaaacaggcaggcagagacaaaagaagaaaaccacgctagatccgcgcgtccaaccacacgaagcaagcaacacacacacgacacaagtagcagcacatgaaaaacaaaaccccaccgaagagggagacacccgcgacatagcagacgggcacaaaaggccacacactagtcagtcagacaccaaggacacc

SEQ ID NO: 80366 - DNA, 3991 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtatgttctaaaaatagtttttttttgtcatttacaatagtagtttttataatctatattgttcataaaacaatgcttaatttaagagtttcacagcacccagaagtgcttaccatattataacatagtgactttcaaagatatgtaacacaggtgctcttaagcttttgcctttttgtcctattattaacaagtcagtaaagttaacaggtaaagtactgctaatgggtacaaattaaggaattgcagcaaaaaagtattgcctactaactctgacattataccttgtttgtacccgccagcgggaacttcattgcaggccctgtgtcgcgctgacttcacgattctcacaggcccgctcaatgcggacagggtacgagatgctcacgctctcgaatgctgccgtttggtatggtctcttccaacatcctgtatcagcattataaaataaaatggatacttcaagctttgccttcacttatttctttgctttttaaaaactatttgtaatgtaattttaatgcattttttacaggcccagtaatggttaaatacgtcagcttactgaataattttaactatttattcttctaaggatacagcttgtctctggattttccagtcttaattttatattttattaatctattttaatgcttgcttttcccatttatagacgttgtagcagtaattgcaagaagttcttgagctgaattcctgttgtgacaacttcctataattacagtagataactttttcttttagtcgtatataacttttctataacttgtgatggacaagagatatgcttatccaataaaataagcttaaatattagatgctcttgggtcaaaatgtccttttaccaaattgacctttttatgagttctttgggtaaatactttaaagctttttatattttaaagaatacttgtaaaagcatatcacatcttaaaccagtggtgcacatgtggatttacagctcatggactctactgttcagctttaatttataaaacatatcacacatttaatgttatacagtatttacatatagtggaacatagggataactcagttttatgtaaatttttgttaagtgttgtagcctgcccagagtgacttctattttttcttctttgtctccaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgcttatttgtttgaatgattttattttccatttctcaaaggttttatttttttggttagggccttaaaatttcaggactgtgattattagtatgtgtgcctaaggaactttttgagtcactcttaagaaagtgaaactgaagagtctaagtgataactataggattaagtcagaattgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgatggaatacctttcttacttttgtggagttacatctgatgctaagaatttgacctccaactaagcaaacattttaatgagcaaaagttagtgttattaaagttttttatgatagatccaaattgaggacctgtgtcctgtttttataagattgcaacccagctatgctcatttgtttatgttttgtatatggctgcttttgtgttacagtggtagagtttagtagttaggacagagacctgcaaagcaaaataatttacagtctggccctttacagaaaagtttgctgactcatggtcaaaataaatgaaaattttttgtgttagggttgttaagctagggttctttttggtatcatatgcttattttatgtaaatctctcaataaaaaattatttttaagagaaaaaaaaaaaaaaaaaaaaaaaaaaaaaaaaaggggggggggtaaaaatttccctgggggggcccaggttaggggtcccggtttttgttaaggggggcccctattggggggcccgattttaaaccgcaagggaccggggccgggcggttaacccacggtccgggcctgtggacaccctggcgttccctggggaccctgtggggaggggaccccttactttcttggggtgggccttatctgtgcgcgacttacctacggggagttaaggcacccggcgggaattttaacattttcaggtctttctgctgtgatccaacgctggatatgtctcgcggtggaaagtttcggtcacgggttgctttagacatttttcccagcggc

SEQ ID NO: 80367 - DNA, 1120 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttca

SEQ ID NO: 80368 - DNA, 2460 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtatgttctaaaaatagtttttttttgtcatttacaatagtagtttttataatctatattgttcataaaacaatgcttaatttaagagtttcacagcacccagaagtgcttaccatattataacatagtgactttcaaagatatgtaacacaggtgctcttaagcttttgcctttttgtcctattattaacaagtcagtaaagttaacaggtaaagtactgctaatgggtacaaattaaggaattgcagcaaaaaagtattgcctactaactctgacattataccttgtttgtacccgccagcgggaacttcattgcaggccctgtgtcgcgctgacttcacgattctcacaggcccgctcaatgcggacagggtacgagatgctcacgctctcgaatgctgccgtttggtatggtctcttccaacatcctgtatcagcattataaaataaaatggatacttcaagctttgccttcacttatttctttgctttttaaaaactatttgtaatgtaattttaatgcattttttacaggcccagtaatggttaaatacgtcagcttactgaataattttaactatttattcttctaaggatacagcttgtctctggattttccagtcttaattttatattttattaatctattttaatgcttgcttttcccatttatagacgttgtagcagtaattgcaagaagttcttgagctgaattcctgttgtgacaacttcctataattacagtagataactttttcttttagtcgtatataacttttctataacttgtgatggacaagagatatgcttatccaataaaataagcttaaatattagatgctcttgggtcaaaatgtccttttaccaaattgacctttttatgagttctttgggtaaatactttaaagctttttatattttaaagaatacttgtaaaagcatatcacatcttaaaccagtggtgcacatgtggatttacagctcatggactctactgttcagctttaatttataaaacatatcacacatttaatgttatacagtatttacatatagtggaacatagggataactcagttttatgtaaatttttgttaagtgttgtagcctgcccagagtgacttctattttttcttctttgtctccaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaacacaaaaaaaaagtcgaggcggccggaagtttag

SEQ ID NO: 80369 - DNA, 973 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttca

SEQ ID NO: 80370 - DNA, 2106 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtatgttctaaaaatagtttttttttgtcatttacaatagtagtttttataatctatattgttcataaaacaatgcttaatttaagagtttcacagcacccagaagtgcttaccatattataacatagtgactttcaaagatatgtaacacaggtgctcttaagcttttgcctttttgtcctattattaacaagtcagtaaagttaacaggtaaagtactgctaatgggtacaaattaaggaattgcagcaaaaaagtattgcctactaactctgacattataccttgtttgtacccgccagcgggaacttcattgcaggccctgtgtcgcgctgacttcacgattctcacaggcccgctcaatgcggacagggtacgagatgctcacgctctcgaatgctgccgtttggtatggtctcttccaacatcctgtatcagcattataaaataaaatggatacttcaagctttgccttcacttatttctttgctttttaaaaactatttgtaatgtaattttaatgcattttttacaggcccagtaatggttaaatacgtcagcttactgaataattttaactatttattcttctaaggatacagcttgtctctggattttccagtcttaattttatattttattaatctattttaatgcttgcttttcccatttatagacgttgtagcagtaattgcaagaagttcttgagctgaattcctgttgtgacaacttcctataattacagtagataactttttcttttagtcgtatataacttttctataacttgtgatggacaagagatatgcttatccaataaaataagcttaaatattagatgctcttgggtcaaaatgtccttttaccaaattgacctttttatgagttctttgggtaaatactttaaagctttttatattttaaagaatacttgtaaaagcatatcacatcttaaaccagtggtgcacatgtggatttacagctcatggactctactgttcagctttaatttataaaacatatcacacatttaatgttatacagtatttacatatagtggaacatagggataactcagttttatgtaaatttttgttaagtgttgtagcctgcccgtcgacgcggccgcgaatttagtagtagtaggcggccgc

SEQ ID NO: 80371 - DNA, 1347 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcaaaaaaaaaaaaaaggggcggccgccctttttttttttttttttttttttttttttttttttttttttttttttttttttttttttttttttttttttttttttttttttttttttttttttttttttttttttttctttcccctgaaaaaaaaaaattcttttttctaccgcggcgaggaagtagcccacatacagttccttgttgctgggtgcacttactccggcacaaaccaccgatcgactatttaaaagccagtagggatcaacctaaacgctcacactagaatatggcgtcacatacctgcttactacagcggctagacaaacaagaaacaggcaggaccaacaaagtatatatacaaccgtaaagaaa

SEQ ID NO: 80372 - DNA, 2351 bp, Homo sapiens
ggctcggcacctcatgctttatacttcccgcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatccgaaggaacaatatcagcaacagcaacagtggggatctagaggaggatttgcaggaagagctcgtggaagaggtggtgaccagcagagtggttatgggaaggtatccaggcgaggtggtcatcgtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgcttatttgtttgaatgattttattttccatttctcaaaggttttatttttttggttagggccttaaaatttcaggactgtgattattagtatgtgtgcctaaggaactttttgagtcactcttaagaaagtgaaactgaagagtctaagtgataactataggattaagtcagaattgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgatggaatacctttcttacttttgtggagttacatctgatgctaagaatttgacctccaactaagcaaacattttaatgagcaaaagttagtgttattaaagttttttatgatagatccaaattgaggacctgtgtcctgtttttataagattgcaacccagctatgctcatttgtttatgttttgtatatggctgcttttgtgttacagtggtagagtttagtagttaggacagagacctgcaaagcaaaataatttacagtctggccctttacagaaaagtttgctgactcatggtcaaaataaatgaaaattttttgtgttagggttgttaagctagggttctttttggtatcatatgcttattttatgtaaatctctcaataaaaaattatttttaagagaaaaaaaaaaaaaaaaaaaaaaaaaaaaaaaaaggggggggggtaaaaatttccctgggggggcccaggttaggggtcccggtttttgttaaggggggcccctattggggggcccgattttaaaccgcaagggaccggggccgggcggttaacccacggtccgggcctgtggacaccctggcgttccctggggaccctgtggggaggggaccccttactttcttggggtgggccttatctgtgcgcgacttacctacggggagttaaggcacccggcgggaattttaacattttcaggtctttctgctgtgatccaacgctggatatgtctcgcggtggaaagtttcggtcacgggttgctttagacatttttcccagcggc

SEQ ID NO: 80373 - DNA, 296 bp, Homo sapiens
taaaaaaaaaagaaaaaaattatccaggcgtgatggtgcaagcctgtagtcccagctactcaggaagctgaggtgagaggatggcttgagcccaggagatcaataactgcactgagcctttatcgtgccactgcactccagcatgggcaactgagcaagaccctgtctcaaaaaaaaaaaagccaaaaataaagagaaaacacttaaaacagaacaagaaaaatgacctgccacatgtaagataaatacaataaaattaacacctgagatccaatcaggaactatggaggccggaa

SEQ ID NO: 80374 - DNA, 352 bp, Homo sapiens
aggagtatactgtaagagtctatcagtttgaaagcttagaaaccctaatgtccaacattccgataacctctgggtaaactaagtgacagcaaaatctaagtagtctgtctggatttgtaccacttactggaagaaattttattatttttcagccattcactgaactcccaggattttggagttgaatcataaaacgggaaaaaataagacagattatgcaatgcttcttttaatttactgtttttggggggttttgttttgttttgttttgtttttgttttttgagacagaacctccctctcttgcctaagctggaatgcaatggcacaatctcagctcactgcaacctctg

SEQ ID NO: 80375 - DNA, 321 bp, Homo sapiens
  misc_feature (112)..(112): n is a, c, g, or t
  misc_feature (222)..(222): n is a, c, g, or t
gcacaacttgcatgacttggctttgctgtccttactctaatcccaaccctgtctgatcctcctttatttaaaatgcccatattctggctaggcatggtggctcatgcctgtnaccccagcactttgggaggctgaggcaggcggatctcttgagctcaggagtttgagaccagcctggccaacatggtgaaaccacgtgtctactaaaaatacaaaaattanttgggtgtggtggcacatgcctgtagtcccagctactcaggagagtgaagcaggagaattgctggagcccgggaggcggagaggttgcagtgagccgag

SEQ ID NO: 80376 - DNA, 851 bp, Homo sapiens
ggcggcggcacagacatgggtctcagtgccggacgctaaccccacatgtggaggccccgtgagccccagccagctggaagcacggccacagtctctttaagacaagatcccggcctgagccgtccttggtcgtccacctggacagcatgacagatgccgcatccctcattatgaaaggctggggctcagggcagcagccatgatcgagaagccaaacactaaaggcgttttgccagaggtggctggtggaacacaatcctgggggtaaagcagtggcggtgagtgcactttgcaggcgcaggggccaccaggcctgggaaagacagctttggaacggacctaaacaaagcgtggccagtggggcaaagaacgtctgtcaccagggtgaaatagacaagctgcggtacacagccagctggaacgcatgacggcatccgtgaatgtgcacagaatagattcttaacgctgtgttttttcagatatcatattccagagtgagttaaaatgaaattagtgatgagaggtggaatttccatatttatctgcctctgggctgaaatttctcaggctgaggagaaagcggtgctaagaacccagcgtttacaagcaggaaaataatgaagatgggaagcaaagtaccacttcctcatcacacgcctgctgcaagcaggttcccccttatctgtctccgcttgagaatctatttttggaaaccctgctggacagggacgatcgtactgagtgtcctcaaacagcatttaatcagcgctggggctgcagaccagatgcacactgagagggaggccgaggagcacgggtacctcgtgtcctcaccagcacatgatgtgccc

SEQ ID NO: 80377 - DNA, 331 bp, Homo sapiens
aaaaaaaaaaaaaaaaaaggagagagagagagacgggatctcgctatgttacccaggctggtcttgaacttctaggctcaagcaatcctcctgcctcggtctcctacagtgttgagattacaggtgtgagccattgttccaaaaattgatatacttggcctcacatcaatttttggaacaatgcaggtaataatgagggggaaaaaattttaaaagtcccaattaccctttaaacaaatattacctcctccaaaaaatatttttctagattcctgaatgtattttttggtggaggaggaactcaaagtagaattcatttacatattcattc

SEQ ID NO: 80378 - DNA, 482 bp, Homo sapiens
tgaaaacacaacccacaatcatcctcctgaggcagattccgctgggactgcattcaacttagggccaactattaagcaaactgagacaaaatgggaatacaacaacgtgggcactgacctgtcccccgagcccaaaagcttcaattacccattgttctcgtccccaggtgatcagtttgaaattcagctaacccaacagccacgttccctcatccccaacaacaatgtgagaaggctcatttctcatgttatccggaccttgaagatggactgctctgagacccatgtgcaattgacctgtgccaagctcatctccaggacaggcctcctgatgaagcttctcagtgagcagcaagaagtaaaggtgtccaaggcagaatgggatacggaccagtggaaaactgagaactatatcaatgacagcacagaagcccagaatgaacagaaagagcagaagtcgagtgagctcacaaaagaagttc

SEQ ID NO: 80379 - DNA, 2659 bp, Homo sapiens
cctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80380 - DNA, 2521 bp, Homo sapiens
cctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaaggttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80381 - DNA, 2151 bp, Homo sapiens
cctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccgctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80382 - DNA, 442 bp, Homo sapiens
taatgacaataatttcggaattttaaattccacctcacaataagggaattttggccttcgaggccaaagaattgggcacgaggagaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80383 - DNA, 343 bp, Homo sapiens
ttaatgtaagaaatattaaataaatgtaataggtatagtaggattattaatgtataaactaagagaaataataaaagaaattgaaatagaaagtatgaaagtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80384 - DNA, 2939 bp, Homo sapiens
cctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaatcagagtggaatggttttgttatagatgctgtatcccactctttattcatgttcacattttaaaatcatttggaattctgcttcactcgcttaacatatacacaacacctgtaacatacaaggcaatgggctaggtgctccagaccgggaaaaggagggacaggaatgcttggtctgatgggctaatatggcatttagagaagtaccaaggtacagtggagccggtcacaaaagggcagacttgtagtagaattcagttgcaagagggattggggaa

SEQ ID NO: 80385 - DNA, 2417 bp, Homo sapiens
ttccggcaacgacgggccagtgatgttcccagtggccttgcgacgagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaaggttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80386 - DNA, 2281 bp, Homo sapiens
cctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80387 - DNA, 2126 bp, Homo sapiens
atactctgatgaggctggcctgtcttttctcatagtgatctgcagagatgaaaaaacgcagatgatataccagcaacatcactacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80388 - DNA, 2135 bp, Homo sapiens
cctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggcccccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80389 - DNA, 1609 bp, Homo sapiens
taagaaaggttaataaaaacaaacatggtatttatttacccaatttttggagaataagtggatgatggcggccataatagtggtgggttaattcagggaataaatgtttgcaaggcaggaatggtaaggaacacctcttactaccatgaagttcaaaaacaatcacaaatagggcaggctccctgactgcctccacacctcacagtttatcatgcattcgtgtatttagcacagactagacagatttttactttataacactttgtattcattcattttccaacgtgcttattccggttcagggtcttgggtggggtggccagagccacctggcagctcagggcgccaggcgggaccagccctggacagacgccaccatcctattgcagagccactaacacccacactcactcagactgggcccacgtagatacatcctcagttggcttaatgtgcaagctttgggatgtggaaggaaaccggggtacctggacaaaacccaggcagacagtgtccccagacaggaattgatttttgttttcctcatcaaagttataatgaaatgacactgaatggaatattattgaagggcctgctgtattttgaagattacgatgttcatgctacacatactgactttctccagatagtctgctttttttgcaaacgccaaacctgctatctcctttgcagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80390 - DNA, 1055 bp, Homo sapiens
cctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcccacaacccggttgtgggcgcgaggtgtagcgctccgggggacggtcggggtcccggctttcgttcagggtgtccccaaacacctccttggccagcgacgtctttccgcaaacggtgatgcgcgccactcgccggaacttggcgtccgcctgcgcgcccacaa

SEQ ID NO: 80391 - DNA, 599 bp, Homo sapiens
ttccggcaacgacgggccagtgatgttcccagtggccttgcgacgagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80392 - DNA, 234 bp, Homo sapiens
caagggtagtgaggcatttcattttgagtcatactctgatgaggctggcctgtcttttctcatagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaaaagtatgtgctgaggctggaaggtggtgcat

SEQ ID NO: 80393 - DNA, 1042 bp, Homo sapiens
  misc_feature (799)..(799): n is a, c, g, or t
  misc_feature (807)..(807): n is a, c, g, or t
  misc_feature (817)..(817): n is a, c, g, or t
  misc_feature (823)..(823): n is a, c, g, or t
  misc_feature (834)..(834): n is a, c, g, or t
  misc_feature (841)..(841): n is a, c, g, or t
aatggatataggctaggtacgagctggtggaatcggcaccgaggcgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctcnacctgggnctgagacagncagcangctcagttcgntcaaggngggtcttcgcggatcgcttccacctgggggttgcatcttgcaggaaaggggtgccgggacggtctgggggggtacctcaggctgggttttcttggccccggtcaggagtgtcgcacctacgttttggacatcgggctgggggggagtttccatttccgatgtgggacaggggattctcggaagtgactcccgcgggggtag

SEQ ID NO: 80394 - DNA, 2584 bp, Homo sapiens
aaagaaaaaaaaaaaaggacatgctacagcatggatgcaccttgaagacatttgcaaagtgaaacaaaccagtcgcaaaagaagaaacactgtctgattccacttctaggataatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80395 - DNA, 2811 bp, Homo sapiens
cctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaatcagagtggaatggttttgttatagatgctgtatcccactctttattcatgttcacattttaaaatcatttggaattctgcttcactcgcttaacatatacacaacacctgtaacatacaaggcaatgggctaggtgctccagaccgggaaaaggagggacaggaatgcttggtctgatgggctaatatggcatttagagaagtaccaaggtacagtggagccggtcacaaaagggcagacttgtagtagaattcagttgcaagagggattggggaa

SEQ ID NO: 80396 - DNA, 2149 bp, Homo sapiens
cctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacaatggcaagaccccatctctacaaaaattaaaaaataagaagataaaaaggaaaccttaaactctcttatcatttaggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80397 - DNA, 1412 bp, Homo sapiens
cctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggcccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcca

SEQ ID NO: 80398 - DNA, 349 bp, Homo sapiens
cctggcctgtgctttgatagagacgcagctcttcacttgggaacaccggaagcctcgtgagccccccaggtcttgcatgacactttgaataatctcttctgttcagccatgagtagtacgatgttactgatggcttgtggtctgaccacgtgcgtgctcattgtcagtctcattggcttttcctttgttctagaacatggcaggggagctgcagacagacaggtacagcgcctagctttacagttacatgcacgctgtgtcatcagtttctttccccccttcatagcagccagagctctaaacactcattgctaaactaaccccaaggcgctggtgaagtgttggacta

SEQ ID NO: 80399 - DNA, 4952 bp, Homo sapiens
cagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagctgtatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagcaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcagtgtcatttcaggctctttgtcacatagcgaacccagtcatgggctagctgatagagtcattaattgcagagaagttctggaagctttcaacctcctggtgctccaggtcagctccttcccatacactctgcagacccaacagtcccgcattagctctagcaatgaggttcactggatacagctggatactggggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacacatgctcattatcagggtgccctcggtgcagctggcgatgttagccaaggagcggctacaggaggtgcgcgacaaactgggtctgcagtatcggtttgagatcatccttgggaacccggccaccgaactcagtgttgcaactcactttgtggcgcgattaaagagttggagaggaaatgaaccagaagagtggatccctcggacataccaagatttagacggtctaccttgtattgtgatattaactggcaaagatcctcttggagaaacctttcccaggtctttgaagtactgtgacctccggttaattgactcaagctatttaactcgcacggccttggagcaggaggtgggtctggcatgctgctatgtctcaaaagaggtcatccggggacccactgttgccctggacctcagcgggaaggagcaggagagagctgctgtcagtgagaatgactccgatgagctgctcatcgacctggagcggccccagagcaacagcagcgctgtcacagggacctcgggttccatcatggagaatggagtgagctcttccagcacagctgacaagtcccagaagcagtccctgacccccagctttcagagcccagccaccagcttggggctggatgaaggggtctccgccagctcagctggagccggagccggggagactctgaagcaggagtgtgactccctgggcccccagatggcgagcagcaccacctccaagccgtcatcatcatcctcaggacccaggaccctcccatggccgggacagcccatcagaggctgccggggcccacaggcagccctgccaccagtggtgatcctatccaaagcggcctacagtctcctgggctcccagaagagtggcaagctgccatcctcctcctccctgctgccccacgccgacgtggcctgggtgagctccctgcggccactcctgaacaaggacatgagcagtgaggagcagtccctctactacaggcagtggaccttggcccggcagcaccacgctgactatagcaaccagctggacccggcctctggcacccgaaacttccacccccgacggctcctgctgacagggcccccacaggtgggaaagacgggctcctatttacagttcctcaggatcctcttccgcatgctcatcaggctcctggaggtggacgtgtatgatgaggaggagatcaacaccgatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaagaagtgataaaggaatccaaagttgaagagcccaggaaacgggaaactgtatccataatgctgaccaaatatgcagcctataacacctttcaccactgtgaacagtgccgccagtacatggacttcacctctgcctcccagatgtctgactccacccttcatgccttcacattctcttcttctatgctgggagaagaggttcagctctatttcatcattcccaaatccaaagagagtcattttgtcttcagcaagcagggcaagcacctggagagcatgcggctgcccctggtttcagacaagaatttgaatgcagtcaagagccctattttcactccttccagtggtcgacatgagcacggactcctaaaccttttccacgccatggagggcatcagccaccttcacctcctggtggtcaaagagtatgagatgcctctgtaccgcaagtactggcccaaccacatcatgctggtgcttcccggcatgttcaataatgcaggcgtgggtaaggggcccccctgggatggggagaagggcttcgaagataaactgagctccattcccctggcatgaaactttcagattcccctgcctctagaaattgtcctgccctcctcaccactcttcggaaa

SEQ ID NO: 80400 - DNA, 1147 bp, Homo sapiens
  misc_feature (748)..(748): n is a, c, g, or t
cagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcaggagtggtcgaggagagcgcgcgagaggttgggagggaatctggagcaaaggagttttggtaaacccggcgtacgagcgtgccagaaagtgggtaaggtcgtgggattgtgtgtcctaaaccagagtgcttaagacagttttaagtgcacaatgggagagcattgactgcaaagaacgagtgcaagaaaatgtgtccctggaggtatcaaaaaaacaatggcccccaaaccccccgaagaaggttttccccctttaattttcccagcgtagagaggaagaagccccttttgtacgccccccaaagaggaaaagggggcacnttcattttggaccaacacataaaaccaaaggaaattatgggggttattatgtagtgggttccagaaaagggccaacgggaacaaaacagggaagttctcgcaaggttttgtgggcttcacttcagctaggtgtgtagttaccttggggagaagcaaaagagtttgagaagccgagttcaccaccaaaggcacaaaggaggcaattattcccccgtttccactattgggggaattgaggagggggggggccccccaaaaaagtgggggttttccttttttcaccccctacccaaaaaaaaatatcccatttggggccaccccgtggggaaagaagccgagctgaagttccctttaagggattttatgcttggcccttgattggggcgaacccaaggccgg

SEQ ID NO: 80401 - DNA, 3020 bp, Homo sapiens
cagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagctgtatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagcaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcaggtaagagtgaactttcaaagaggagcccacctagatccagcttcagatcccctctgcctctttcttttgcttaatccaaacgtctagaggatgcttaaaaccttcttcagtaataaaaatcataaaagcactttgttattttgggtttatctgaagttttccctcaaagtactctgtcctttttccctcaaggtcaagggtaaattgttgtgcatgtttgccaggtatcattaagttcatgatgtaatctgtgggactagaatctggtcatttatggatgaagagaaattttctcaaggcgaggatggccctgcatgggttgatggcgtctgtgccacctgaactcctcccacctgcaggcctcatttgcataggtggattcttggccatctagcacattaacagcacgtctgggacctggaaaccagaacaccatcccccatgtcagcaatgacgttctttaagaaaaaaaggttagcgttatttctaataactttaagtgtaaagaaaaaaaaatgtttttcccagaaaatgtgaaaaggtagagagcaaaaattttacaagtct

SEQ ID NO: 80402 - DNA, 2348 bp, Homo sapiens
cagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgcacaaaaagctttaaacaagttaaaatctaggcaacagactccctgaagtgttgactgcccaacttaatcatgactgtgattcaaaaatgttaataaataaaccaaggtgtagatcatggggaattcatatgctgggcaactgaaatctgctcgatttgaggaagctctccacaactccatagaagcctccctcagatgtagtagtgtggtaccacggccaattttttcccagctatacctggaccctgaccagcatcctttctcatctgcagatgtcaaacccaaggtggaggatctggacaaagatttggtaaaccgctacactcaaaatggaagtctggatttttctaacaatctaacagttaatgaaatggaagatgatgaagacgatgaagaaatgtctgattcaaacagcccaccaattccctattcacaaaaacctgccccagaaggatcttgcactacagatggtttttgtcaagcaggaaaggatttgcgtttggtatcactgtgtatggaacaaattgacatcccagcaggattcctcctggtgggggccaagtctcccaatctgcctgaacacatcctagtttgtgctgtggacaagcgatttctaccagatgatcatggaaaaaatgcacttttagggttttctggaaattgtatcggctgtggagaaagaggatttcgatatttcacggaattttccaaccacattaacttgaagctcaccactcagccaaagaagcagaagcacttaaagtactacctagtcagaagctcccagggtgtactgtctaaaggacctcttatctgctggaaagaatgtagaagccgacaatcctctgcttcttgccactctattaagccaagctcttcagtgtcgtcaactgtgaccccagaaaatgggacaactaatggatacaaatcaggattcactcagacagatgctgctaatggaaacagtagccatggagggaagggcagtgcatccagctccactccagcccacacagggaattactctttgtcaccacgacctagctatgcatcaggagatcaagctaccatgttcatttctgggccaccaaagaaacgacaccggggatggtatcctgggtcacctctcccccaacctggcttagttgtacctgtccctacagttcgccctctttcaagaacggagccccttttatctgccccagttccacagaccccactaactggaattttacaacccaggcccattcctgcaggggaaactgtaattgttcctgaaaacctgctgagtaactcaggagttagaccagtaattctgataggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtcagcaccagtcccgagctctggcagagagcatgctcaccacaagtgagtttttgaaagaaattagttatgagctgtatcacaggaaaggtcagtttcctggcatcacatttcaaaaccacatcattaggtgagtggttgtaagatttggcaacactggcagcccctagttgtatgattttctgagtttaaatcttagcctgtcaagatgagtgtggagctcaagcttgccagctgatctttcatttgaaatggtttatcctaagtattttgtcactaacaccacaggaagcagtaagggggtctagaggaaggcccattggtactggattcaaaagtctcagctcagccacaacc

SEQ ID NO: 80403 - DNA, 262 bp, Homo sapiens
taccggtgccaattagctgtgccctgttaaccatgctgtgagccagaaatagaagcaacctgttttcaatgaacagatcaaaatttagtgctgtgttgatggttcagaaatgaagattttttgacacggtgggcggggggtgagctaaacaattacagtgcggctgtacatggcagggcagggaaaagagcgacgtggaggccccatgacccagggaaacccgctgagtttacaccaaggatgatgcagagctgtgtgcgat

SEQ ID NO: 80404 - DNA, 175 bp, Homo sapiens
actctgtcctccagcatctgaggcttgggatctcccagaaagtcacaccaggatgggagcccaggtcgtttgagctgggtgctcttggctgctcacttgccttcttcctgtctaggccccttataggttcacctggcactgggacttgaagtagttatggcctgaggtctcactt

SEQ ID NO: 80405 - DNA, 850 bp, Homo sapiens
atttaaagtttattcacacgtacaaagcaatgacaaccaccaggcattttcgagatctctttttctcttggcaggctctatcttgtgtaatgatcactgaacgttgttgaccgcgacactcaccagctgcagccttttccttagtgcttcccttaaaaaaataaaaaagagaaaagaaaaaaaataggagaagaaaaaccacacctaactgtgtatcttacttccttgggggggaaaggattacataattgtgggtctgaattcccatattgtatcagtacttgtggtttgtcatctctctaattgttgtaagtttacatgcttgtattatttcatcacaatttgctataaactattgaaaatgactgtgggatctgtctgtgttgtttgccttttgaaagtgtacttttctttaatcatctcttaatccagaaataataatgcagaacatcccaggaactgatcctgatcctcagtgctctgatctcaacacgtgcatcttaaatcctttgctagatatagtgcctaaaaagcccaagcacgctcggctttgaaccagtgttgatcagttttgtttattaaacaatgttgatgtcctcagatatggtgtatgaaggataacaaaaagcatattaagaatttacaattatttttgagattattttttaaaatcgacatcttggcctttaactctgtgcttctaatcagtctctaattgaataaggtcctaatcttttacctgataggtaaataaagatggaataatctgatgctgaaactccttcacatatctctgttttaagagcaagtcaagacgtgttttttgctgccgaataaaatgttgcaacca

SEQ ID NO: 80406 - DNA, 757 bp, Homo sapiens
catggtggcccatgagtgtaatcctagcactctgggagaccaaggcaggaggatcacttgagcccaggagttcgagacccttggcaacatagtgagaccctgtctctacaaaaaaattataaaattaggtgtggtggtgcgtgtttgtagttccagttacatgggaggctaaggagagaggattgcttgagactgggaggtcaaggctatagtgaccatctcgtaccacggcactgcaacctggtgacagggcaagaccctgcctcaaaaagaagaagaagaaaaaaaaagacaagtttccagattgaaaggcactaacaagtgcaggcttgaccagcagcttgattccattcagactaattgtaaaaacaggcacttactctaggcatcaacatgagtgacccagcccttccaaatggcagttcatagcttatgtctccatggaggggtgtctctgtaatctactattactacccaagtgaagtaactggcaagagcccaacactcaggaaaaagatatcataacttaatccttaggaatactgtctaaggtaggagttagaaaacttgttttctgaaaagagcagatagtaaatagttttggctttgcaagccccatacagtctcaagtgtgtattctttttcccccaatgctttaaaaaatgtaaaaatcctcccaagctaagagcaatagaaaaacagattgtagccaaatttggcacacagactgaagtctctcaacccctggtccaagaaa

SEQ ID NO: 80407 - DNA, 548 bp, Homo sapiens
ctaaagatttaaatatatatacagatacagaaggtttgtttctgagtttctgtagtgaccttggcaataccttgtagttcaggacaatcctgaggaacacagaagtgctggcttccttgaggaatcagtgatcaggactctcgagccccttgaaccccagcatagggcgggagggggtgagggcagcaggggtgggtgtctgaattaatgtcaggtctacgtgatggtgtcatcaagtgttccagataaaaagttttattgagccgggcgcggtggctaatgcctgtaatcccagcaccttgggaggccaaggcgggtggattgcttgagcccaggagttcgagaccagcttggggcaacatggtgaaaccctatctctataaaaaaaaaaaaaaaaattagccaggtatggtggcgtgcacctgtggtcccagctactcaggaggctgaggcaggaggatggcttgagccaggaagcagagattgcagtgagctgagatggtgccattgcaccccagcctaggcaacagagtgagaccctgtctcaa

SEQ ID NO: 80408 - DNA, 424 bp, Homo sapiens
agaaattctaacaacccggattggatgtccccaagttgcccaacctgctaaggtcaccctatcatctaaaatcaaaattaaaatggtcgaaccgaaccccagcttacctgtagtgggaaacccaacacccttccccgtaatatctccaaaagaggcttgtggtggtgggttagacaaggggcagtggtgattggtttaggcaaatcaggatcaatcccttgaaacttagatatgcttaagtatgcataagtgaaatgaatgacagcaaccatagaaaggaatgagagggaggaattaggattattttgttattataaagcacttgtattacctgtgaagtgacacattgttatttggaagtggacttgaattaattgtaaatgtatattgcaaacttttggggaaccactaagaaaaagttttt

SEQ ID NO: 80409 - DNA, 200 bp, Homo sapiens
gatattttcaagggataggattgttcagggttgaattcccaattatctcctgctgtcagaggctggataaaacaaagccttcggcatcaaatgtaattagctctattgacttatgtttttaatgttaaaattatattcctttttggggaggatgaacaaatacccccctttctcactatacactaatatccttgaaaact

SEQ ID NO: 80410 - DNA, 282 bp, Homo sapiens
tgaaaggcaaaaaataaataaataaaaataaataccatttgcagagacagagaaaccatcagaagaagacaagcaaggttgtttgaattaccacgcctagaatttagaataactactatgattaaaacgaaaaaggctttaatagataaaatagatagctcctaataacagatagtaataacatatgggtaatgtgagcagagagatggaaatcttagaacaacaacagcaacaacgacaaagcgttagggatcaaaaacactgtaacaaaaattaagaatc

SEQ ID NO: 80411 - DNA, 1762 bp, Homo sapiens
  misc_feature (791)..(791): n is a, c, g, or t
  misc_feature (1160)..(1160): n is a, c, g, or t
catgcacaggtatgttcattgcagcactactcgcaatagcaaagacttggaaccaaccgaaatgtccatcaatgatagagtggataaagaaaatgtggcacatatacaccatggaatactatgcagtcataaaaaggatgagttcatgtcctttgcagggacatggatgaagctggaaaccatcattctcagcaagctatcacaaactatcgtaggaacagaaaaccaaacaccacatgttctcacttataaatgggagttgaacaagaacacatggacacagggaagggaactcacacacccgggcctgttagggggtgggggcctaaggaagggataacattaggagaaatacctaatgtaggtgacaggttgatgggtgcagcaaacgaccatggcatgtgcatacctatgtaacaaaactgcacgttctgcacatgtaccgcagaacttaaagtataataaataaatatataaatatttataaataaataataaatacataaatatcagaaagtaaaagaggaaaaaaactgaaccttgaatttttttcttttagaatatttataatatttaacgtatttgaaggtgaaggccatcctacatggacatctgaagctttagctaagtattatcttttctgtaatgtgactattggtttgcagttcggttcttcttttcgaatagtatgagattaattttctcagtacttaaatcactcctcagttaagttggatgttcatggaggaacattctttccttcaggttgctgatacatttgctgcactgtnggggagggagtgggtatctgagttagtcagttttaccatttataaaatgtttggtggaggaaattgaaactaattgctaaattgttagtaaccagtgcattaactaggaccctactgagtggactgaaagaatcgaaaatgtttaactggttgagaggcaatgatgttgcaaatggggtattcttcaaagctccttctttttttaaatcttcaaaggcaattattctgaatgtaaactacagaccaaattgcagtcttctgtaagcatttcagagattacctcaaatattttttgattaaaaaactcttccgtggtcttttgtgcttcagaactacccagtacaacagggtcttcagcctgctcagganctctaaagagagctagcacacagtcagccaactttggctgcttcaactcctaggaacaagaaatgatgctgagataatttgtctggcaggtattatcagcccacaatgactgctgtcatttagcctcaaaatgtttatttttccttttacaatgctgtatttctttagaaccttcctattccgagtgtggaccctaggccagccccatagacttcccctggggacttgtcagaaatgcataattttaggccccaccccagacctgttggaccagaatcttcatttaacaagatgcccagaaaacctgagataatcaaagacccacaactaagtaagacctctcaggatctcaaagccaagtgttttacagagaagagaagatagaaaaggcatattatctaggagtggaaaagaattttatgctgaaaatgttgaagagagaattcaaaatcaaattcaacattccacctaggaggcttccatctctgcttaggagctgagtaatggaggtgattggtgtaagtgttcagtacctatgaagacctaactcttgagggagagactccaatgtaaacttcctactcaatactgccttaaaaaaa

SEQ ID NO: 80412 - DNA, 443 bp, Homo sapiens
aagtattatgttgataccagtgttttaatttgaatcaaaagtaatgatttaaccaaagttgtgcttccattattaactcagaaacactaagaaacgaaatcactttttcacttcttatttcccactgatgctgacaaaagaaaacctgagataatcaaagacccacaactaagtaagacctctcaggatctcaaagccaagtgttttacagagaagagaagatagaaaaggcatattatctaggagtggaaaagaattttatgctgaaaatgttgaagagagaattcaaaatcaaattcaacattccacctaggaggcttccatctctgcttaggagctgagtaatggaggtgattggtgtaagtgttcagtacctatgaagacctaactcttgagggagagactccaatgtaaacttcctactcaatactgccttaaaaaaa

SEQ ID NO: 80413 - DNA, 1745 bp, Homo sapiens
  misc_feature (791)..(791): n is a, c, g, or t
  misc_feature (1160)..(1160): n is a, c, g, or t
catgcacaggtatgttcattgcagcactactcgcaatagcaaagacttggaaccaaccgaaatgtccatcaatgatagagtggataaagaaaatgtggcacatatacaccatggaatactatgcagtcataaaaaggatgagttcatgtcctttgcagggacatggatgaagctggaaaccatcattctcagcaagctatcacaaactatcgtaggaacagaaaaccaaacaccacatgttctcacttataaatgggagttgaacaagaacacatggacacagggaagggaactcacacacccgggcctgttagggggtgggggcctaaggaagggataacattaggagaaatacctaatgtaggtgacaggttgatgggtgcagcaaacgaccatggcatgtgcatacctatgtaacaaaactgcacgttctgcacatgtaccgcagaacttaaagtataataaataaatatataaatatttataaataaataataaatacataaatatcagaaagtaaaagaggaaaaaaactgaaccttgaatttttttcttttagaatatttataatatttaacgtatttgaaggtgaaggccatcctacatggacatctgaagctttagctaagtattatcttttctgtaatgtgactattggtttgcagttcggttcttcttttcgaatagtatgagattaattttctcagtacttaaatcactcctcagttaagttggatgttcatggaggaacattctttccttcaggttgctgatacatttgctgcactgtnggggagggagtgggtatctgagttagtcagttttaccatttataaaatgtttggtggaggaaattgaaactaattgctaaattgttagtaaccagtgcattaactaggaccctactgagtggactgaaagaatcgaaaatgtttaactggttgagaggcaatgatgttgcaaatggggtattcttcaaagctccttctttttttaaatcttcaaaggcaattattctgaatgtaaactacagaccaaattgcagtcttctgtaagcatttcagagattacctcaaatattttttgattaaaaaactcttccgtggtcttttgtgcttcagaactacccagtacaacagggtcttcagcctgctcagganctctaaagagagctagcacacagtcagccaactttggctgcttcaactcctaggaacaagaaatgatgctgagataatttgtctggcaggtattatcagcccacaatgactgctgtcatttagcctcaaaatgtttatttttccttttacaatgctgtatttctttagaaccttcctattccgagtgtggaccctaggccagccccatagacttcccctggggacttgtcagaaatgcataattttaggccccaccccagacctgttggaccagaatcttcatttaacaagatgcccaggtgattcattcatgtttgagaagctctgctttaaatcactaaagcagttactgagtaattactaccatcatgactctgaagagctcctatagccttcaaatgcacctaactctactctaaaggcaaatgtcctcactgggaaatctgatctgctgtttcagagaagtgcagggctacacagtgtcttacactcctatctattgatgtttcttggttttgcctggtaatctgctgcttaaatggattatttgatgacatattgatattaaaacagtcctatttttag

SEQ ID NO: 80414 - DNA, 1912 bp, Homo sapiens
  misc_feature (167)..(167): n is a, c, g, or t
gctttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttntaaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 80415 - DNA, 510 bp, Homo sapiens
aagcagtggtatcaacgcagactggccattacggcgggttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 80416 - DNA, 503 bp, Homo sapiens
ttgcccctggaggccaagaatttcggcacgattgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 80417 - DNA, 981 bp, Homo sapiens
  misc_feature (167)..(167): n is a, c, g, or t
gctttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttntaaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctgga

SEQ ID NO: 80418 - DNA, 483 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctgga

SEQ ID NO: 80419 - DNA, 779 bp, Homo sapiens
catagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaaagcaggggctgccaaaactcttgatttcatatttccttctctaaatatatatgtatcctgttttttggataaaattttaccaagaatccaaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgtagactgatcttgttgattaaattctagg

SEQ ID NO: 80420 - DNA, 656 bp, Homo sapiens
catagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaaagcaggggctgccaaaactcttgatttcatatttccttctctaaatatatatgtatcctgttttttggataaaattttaccaagaatccaaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgaaaaatctcaactctttgtgactgagtt

SEQ ID NO: 80421 - DNA, 550 bp, Homo sapiens
agttttcagttacatggccaaaaatacaggacttgaacataaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgtcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 80422 - DNA, 1414 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 80423 - DNA, 1768 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccaaaaaaaaaaaaaaaaaaaaaaaaaaaaaaaaaaaaaaaaaaaaaagggggggggggcaaaaaaatccccgggggggggcacaaattatccagcggacaccccagcgttttctttgtgtaacaaggggggccccaaaagggagagagcagataaaaagaagagggcgaggagggccgatatataaaacaagcgtggggtgtgcggaaaaaacggcaccggggatctttggaaaagaacccaactccgggcgggggccatatggggaaagcaccaaagaaaattaaggccagggaataaactgcgaggtatgtggtgaacagagcaaggggcgcgaaatgggaccgaagatggaat

SEQ ID NO: 80424 - DNA, 1795 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccagatgtgtgctctgtgtacttcttgtaataccttaaagcaaacacactaacttacacagctttgttaatcagctcccagttcagcctgactttgtgggaacttatttccctaataaattatttagaaactttaacagtgaccatccctgttgttggtaaaagataaacatgtcttggttcaaaagttaatacctcaggatggaatcaagaagcagtagacttaccagtttgattaattaagggagcactggactgggtgcgtaaggattcttaattagcattttttctcatgtttacatccaaggttatgaagtgttgtggaaagcaaagtttaacaatcatatataataaaagataatgtttatactcacagaaaaaactt

SEQ ID NO: 80425 - DNA, 1928 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccaaaaaaaacaaagaagaaggaagctccgtgcccctcctaaagctgaagccaaagcgaaggcttacaaaggccacaaaggcaagtgtgtgaacaggtgtccacagcacagaaaagagcaacagaacgatcacagtacccaacttccggggccgaagacactgcgactccggacgaaagcccacatatctcgggaagagcgctccaggagcaacaggctgacaatatgcaatactaaaagattacagctgaccactggagtctgacctgcacgaaagatagaaaaaacaccgaccactgtgttccattggtggatgttaaagccaaaaccacgaattaccggctgtgaacaagcgattgcctctgtggccaggccaaccctgaatcgccctggcaaacaggcattgtcccggtcctatccagctgcattgcacaatggacaccaggatccggcacgaaattatcatctcacaacaaaagcaatcaccacccccctaccacacaaacgcccacggaca

SEQ ID NO: 80426 - DNA, 1358 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 80427 - DNA, 1270 bp, Homo sapiens
  misc_feature (1240)..(1240): n is a, c, g, or t
  misc_feature (1245)..(1245): n is a, c, g, or t
  misc_feature (1260)..(1261): n is a, c, g, or t
  misc_feature (1267)..(1267): n is a, c, g, or t
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattanggggngggggggggggaagnnctgggncgg

SEQ ID NO: 80428 - DNA, 1309 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 80429 - DNA, 1416 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaggaaacacctgggctgtttatagtattgagctaataaagatttttacacagtcgtagagaaaagggtcctcagaggtgatctaatgtatcctccctctccaagctgataagtaacttactgtgtgagtgcttgcaagttttccagaatcgtaacccacttattacaaggatatcatttctacacctttcaacatcttcatctcccttctgtgtctattgcagtttactgatgttttccttacccagcacttaaaatagacaccgcaactccagaatgatcagtga

SEQ ID NO: 80430 - DNA, 1429 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaggaaacaccggtgtttccctttgtctactgtttttttttgtctatagatgtcttgacgaattcagtctcttgccccctgccttgctttaataaattacaaaaactcaaccaaagataacacttctcagataaaaccagcacatttctgtggcctactgtacatggcctattgaatggctctattgaatgggcactttggccgatagtggaataattgctggacgttccatataatacaggtagaaggtgatcactgcacagacagtctgatgatatgagacatccgtggatcctcgga

SEQ ID NO: 80431 - DNA, 1260 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaggaaacaccggtgtttccctttgtctatgtataggctattttctgataattgtgtaacccactcgttatccttcttatgcatctgccttctggtccattagcggatgatgcgctgtaaaaccacgatgc

SEQ ID NO: 80432 - DNA, 1354 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaggaaacaccatgatagtctaatccttccaatgtacagttatattcttttagcttgaggccaactagaaatctgtggcatcatactttggctccatgggaatatccattccccacatttttgtctgacagttttagcaccccttaatgatcctggcccacatcaattattcataacgttgtaacaattgcagacaaggaaacccgagatcctctagaacacctc

SEQ ID NO: 80433 - DNA, 1167 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaatctaaactgacactccgagacctctggaatcgtcaa

SEQ ID NO: 80434 - DNA, 1346 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttattttgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 80435 - DNA, 1690 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccaggtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccagatgtgtgctctgtgtacttcttgtaataccttaaagcaaacacactaacttacacagctttgttaatcagctcccagttcagcctgactttgtgggaacttatttccctaataaattatttagaaactttaacagtgaccatccctgttgttggtaaaagataaacatgtcttggttcaaaagttaatacctcaggatggaatcaagaagcagtagacttaccagtttgattaattaagggagcactggactgggtgcgtaaggattcttaattagcattttttctcatgtttacatccaaggttatgaagtgttgtggaaagcaaagtttaacaatcatatataataaaagataatgtttatactcacagaaaaaactt

SEQ ID NO: 80436 - DNA, 1246 bp, Homo sapiens
gcatgtgtgaagaaagcacagaggctgaagctgaagccttgtgagtgagaggaagaggccagaaatatgatagggccaggtcacctaaggcctcacaccatttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 80437 - DNA, 1136 bp, Homo sapiens
cgaccgacgatttcggagttgggggtgtttgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 80438 - DNA, 1070 bp, Homo sapiens
ctgagaccggggcatctcttttcttcatactgctcagaacctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 80439 - DNA, 1859 bp, Homo sapiens
  misc_feature (167)..(167): n is a, c, g, or t
gctttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttntaaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtatagtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 80440 - DNA, 925 bp, Homo sapiens
caataagagctactccagcctgggcaataagagctactccagcctgggcaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 80441 - DNA, 729 bp, Homo sapiens
  misc_feature (699)..(699): n is a, c, g, or t
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcatttntgccatgctggagtggtccgagctctatta

SEQ ID NO: 80442 - DNA, 736 bp, Homo sapiens
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattccaccagactgtaagctccgtacgaagggggatggacac

SEQ ID NO: 80443 - DNA, 737 bp, Homo sapiens
  misc_feature (701)..(701): n is a, c, g, or t
  misc_feature (725)..(725): n is a, c, g, or t
gtgatgctgctgtgatctagaggatcccggttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcatttatngcccaggctggagtagctcttatngcccaggctggg

SEQ ID NO: 80444 - DNA, 1812 bp, Homo sapiens
  misc_feature (167)..(167): n is a, c, g, or t
gctttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttntaaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaggaaacacctgggctgtttatagtattgagctaataaagatttttacacagtcgtagagaaaagggtcctcagaggtgatctaatgtatcctccctctccaagctgataagtaacttactgtgtgagtgcttgcaagttttccagaatcgtaacccacttattacaaggatatcatttctacacctttcaacatcttcatctcccttctgtgtctattgcagtttactgatgttttccttacccagcacttaaaatagacaccgcaactccagaatgatcagtga

SEQ ID NO: 80445 - DNA, 1091 bp, Homo sapiens
  misc_feature (167)..(167): n is a, c, g, or t
  misc_feature (960)..(960): n is a, c, g, or t
  misc_feature (964)..(964): n is a, c, g, or t
gctttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttntaaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacactttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcnattnaagctgtggtgctgctggattgatgatgcgtgctgctttttgcctgccagaattgttttacagagggggtagaagagcgcgactaggtgggcaccatgacatggttgccagccaccgatgcatcagg

SEQ ID NO: 80446 - DNA, 1486 bp, Homo sapiens
catagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaaagcaggggctgccaaaactcttgatttcatatttccttctctaaatatatatgtatcctgttttttggataaaattttaccaagaatccaaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgtcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccagatgtgtgctctgtgtacttcttgtaataccttaaagcaaacacactaacttacacagctttgttaatcagctcccagttcagcctgactttgtgggaacttatttccctaataaattatttagaaactttaacagtgaccatccctgttgttggtaaaagataaacatgtcttggttcaaaagttaatacctcaggatggaatcaagaagcagtagacttaccagtttgattaattaagggagcactggactgggtgcgtaaggattcttaattagcattttttctcatgtttacatccaaggttatgaagtgttgtggaaagcaaagtttaacaatcatatataataaaagataatgtttatactcacagaaaaaactt

SEQ ID NO: 80447 - DNA, 282 bp, Homo sapiens
gtattcttcatgtaatagctgaaatctagtatattttaaagatatatctatttaaaaaaaaaaaactctaatgataataagattgattaagtatatatgaaattattgataagtagatatgcagttattgacctggttggttgcacagaatttttcattttcattttgcaggtagcatgttttaatctaaattctaatgtggacattttccattgtaaacagttggctcttcatgaaatgtatatataattaaatatgaataatactaatctttaaggtaaa

SEQ ID NO: 80448 - DNA, 710 bp, Homo sapiens
ttcatccaccagtgaagcttatctcaatcacaagagaagagactagaagcccacaccacacttagacaaatgtcacaaacgatcatctgttcttctaagggccattcatcttttcccaaaatcatttactctgcctgaaattggctacatccctggcttccttctcgcctatgtagagggtatataagctcctaaatctcccggtttttcaggtacttttcttcctgtgatgccaccacacatgtaatcaatttatataccttttctcttattaatttgcctgttgttagtatgtttcagaggctgagttattgaactctcagagggtagagagggaaagtcttcacttttctacaattaagtagatcaatttaacttctaaggataagtctgtctgtttttcccatgttttgaattttgaatcataatgacctgagatccccaattaaggagaaatgggaaacaaatatctgtatgataatctataactgttttcttttatacacaaatctcaatgtcatgaatataaaagtaatgcttgatttggagttcctttacatttattattcaaaaacacccacatggccgggcacagtggctcgtgcctatcatcccagtgatttgggaggctgaaacaagagaaacgcttgagtctaggaatttgagaccagcctgagcaacaaagcaagaccccatttctacaaaaaatt

SEQ ID NO: 80449 - DNA, 895 bp, Homo sapiens
gttagccaggatggtctcgatctcctgacctcgtgatccgcccgcctcggcctcccaaagtgttgggattacaggcgtgagccactgcgcccggcctcttttatgttttttaagggtaagtaatttaaagtgtttctgggacatgatctaaagacccatatcatcaactaattttgttcttttttttgagaccgaatctcactctgtcacccaggctggagtgcagcagcgtgatcttggctctctgcaacctctacctcccgggttcaagtgatgctcctgcctcagcctcccaagtagttggtattacaggtgcccacccagcacgcctggataatttttgtgtttttagtagagatggggtttcaccatgttggccaggctggtctcgaactcctaacctcaggtggtccacccacctcaattaattttgtcttgcggttaagttaaagggacagtggcttctgctgcccttactgatctcacttagtggattagtgtttaaaccgaggctctacaacagcccaagatgtcactttgttgttgggagcaggggagccaggtgtagatggggagtgtgctggggctggcagaattagatcatgattcaggagggtagcatgggggaaaatgtagtcatcagagcctgtgtctgttactcactggacatcactgaacatattcatgtgttctggtggcatctttgaactatttgctcagataactctaatcaaattgtaatgtagaaaactggcttgtcaagacagtttagagatctgttctttagcatctgttgagtataatttaaaaaaaaaatccaagttggaaatgacctgtaaacccatctaattaggcacaataagatattaggttatttttaattatccaaacttta

SEQ ID NO: 80450 - DNA, 351 bp, Homo sapiens
  misc_feature (31)..(31): n is a, c, g, or t
  misc_feature (52)..(52): n is a, c, g, or t
tctcacgagatggttttataaggggcttttncccctttgcttggtatttctncttgccgccacgtgaagaagtacatgtttgctgtctctgtcttttttcctctctctgtgtttcatttcctctctatataagaaaactttatttgaaacagacatggtgaaaactctctttgctctcctatataccttagttcacatacgtaggtagacacattcattttttcatcactttattagaaagcattcaactcacctttttcagccttattatgtgtcaggcactgccctcagcatttcgttataagagaaaataaaacaaaaatggaaggattggtcaatatagccattcta

SEQ ID NO: 80451 - DNA, 668 bp, Homo sapiens
  misc_feature (640)..(640): n is a, c, g, or t
tcaaaacaaaacaaagcaaaacaaaactttagtctctttagggactctctgatagtaatgcagagggagaaaggctttctttgtctcactgggaggaaggttccctacggaaattgaaggcagtgcctgttgacatagcgctgccacctggtggaaataatggtgtaggacatcatgtccagcaccactagcgctgagacactccctgggaagagaaatgtttggagagaaatttgcaagaagttggaagtctcgcagtagcaggtaggaacaagaattataactgctactgtgaccccctaaggctcctcacatcctcttaaggcttggagaaactcacactatgtatattttcctgtatttttgaaaaatgttttcctttatgctttgttgtaatgaaattacctctgatggtcacataccttaaatatttagtatatatatgaatactaaatgtccattttcaggagttagtttacctgcatctaaaatcaggaataggtcacagagagtactgtgagactaaaaaaggtggctgtgtaagggtttgtggccattttcaccccttttgcctggggccattgcagagcgaccctccaatcatccttggttacctaattgacggggaaacaagttgccntcctatcccatgtggatcgcggcgtacg

SEQ ID NO: 80452 - DNA, 746 bp, Homo sapiens
tcaaaacaaaacaaagcaaaacaaaactttagtctctttagggactctctgatagtaatgcagagggagaaaggctttctttgtctcactgggaggaaggttccctacggaaattgaaggcagtgcctgttgacatagcgctgccacctggtggaaataatggtgtaggacatcatgtccagcaccactagcgctgagacactccctgggaagagaaatgtttggagagaaatttgcaagaagttggaagtctcgcagtagcaggtaggaacaagaattataactgctactgtgaccccctaaggctcctcacatcctcttaaggcttggagaaactcacactatgtatattttcctgtatttttgaaaaatgttttcctttatgctttgttgtaatgaaattacctctgatggtcacataccttaaatatttagtatatatatgaatactaaatgtccattttcaggagttagtttacctgcatctaaaatcaggaataggtcacagagtaactgagcaaaaagtgctgttaggtttgtgcatttcaccctttgcctgggatgagaggacctcaatcatcttggtactaatgacaggaaaagtgccctcctatccatgtgtatcggctacgtgactcaagtctccttatttccttttctagcataacaaggggttgttactgttgttttacatctgtgttaatgagataaataagtttaaaataaaaagatgtgtaccaggcaga

SEQ ID NO: 80453 - DNA, 460 bp, Homo sapiens
aagcaggaacctgggaatccaagcagtgggtgttttgaggatgatccagatacacttaggagtattcagatcatgaaactccatgacatgaagggaaaaggtgaggcatcactgcaatatgatgttaaaatagtaatcttggcctggtgtggtggctcacacctgtaatcccagcactttgggaggctgaggtgggaggattggtgaagctaggagtttgagaccagcctgggcaacaaagtgagaccctgtctctacaaaaataaaaaatttagctgggtgtggtggcacctgcctatagttccagctactcgggtggctgaggcgggagtatcacttgagcccaggaggtcaaggctgcgttgagctgtgattacaccactacactccagcctgggcagccgagtgagaccctgtctctgaaaaaataaaacaacaacaacaaaacaaaaaacaaaaa

SEQ ID NO: 80454 - DNA, 482 bp, Homo sapiens
ataccatatatttcagcaaaatattttccctgctacccattaaactacagataaagaatgactgctttgaaagattggctaaagcactggatttaaggttaaaaccctgagtttgatcccatcaccgcatttgctcttacaagtcattttcacttcccttggccatgatttgcctctgtaaaatcatgagccttcggccgtctgccttcagccacagttccagagctcagaaccaggacgtggaaaactgctgtgtaaattatagaggaacaggaacaggaccaggaaggggcaccacgtaaatctcacatctctcctgcctgtccctgttacactaaaaccttttcttgctaaacagaaagcttggctttgtggatcaggacgcgagaggtgtgggtcatttctattttactcttcttcaaattcactgaagagccacattatgtaaacaaagggtgtttggcaggaagtcattttgaaac

SEQ ID NO: 80455 - DNA, 159 bp, Homo sapiens
gtttaagccattactgttttggatgtttttttactcatagccaaagttaatcctaactatacacagttagaattcattcctcataaaggtagtgcctgaatgaaacttttttttttttgagacatagtctcactcttttgcccaggatggagtgcagtg

SEQ ID NO: 80456 - DNA, 606 bp, Homo sapiens
cattcatgtctatcctgactgatttctgtcacagagagaaatttagatattttattaaacttggaagtcattaatgccatataaagcaatgctaagagagtcagcatgtgttactgatgtgttgctgaagattaaagtatttttaagtctcaccaaaaaggtggaaggagccaactgagacacaaaaaaggggctgaggttctattcacggtgagtttctttttttgtttcttccagctctaactaacgtgggtatccaactgcgtggcttttcggtgagccccaatataaaatgtaataattttttttctattcttaggctttatctaccaagaaatgaattggataatccacatcaacaaaaagcatggaaaatttatccaccagaatttgccgtggagatactttttggcgagaaatgacttccaatgacgtagctggatccgattaagtatagtttccccttccccttctgggaaagaattaatgttctttccaacccctgccatgtgcatgttcatatgtcctaagtcttccttgatgatgtatctatatttatatatgtttatatatgttcttcataaatctattaaatatatatagata

SEQ ID NO: 80457 - DNA, 1272 bp, Homo sapiens
agcaacaaagggattcagctgcacgtttgagagctgttggcaagacctcaggacagagtgccctctgtgtctggtggtgattctcagacaccatcacattctgatcctgcattgttagccattctactgactacatctactcctaagttaaggactttcttgagcctatctcatgactggccctttctgaagggaagtatggcagctagttactttaatgagcatttcccaatgggtaaggaacagtctgtgaacctatgagttttgttttgttttgttttgtttttaatttttgagacagagtctcgctctgtcgcccagactagagtgcagtggtgcaatctcagctcactgcaacctcgacgtcttgggttcaagcgattctcctgcctcagcctcccaagtggctgggattataggtgcccatcaccacgcatggcctatttttgtatttttagtagagacaaggtttcaccctgttggcgaggctggtctcaaactcctgacgcccagtgatctgcccacctcggcctcccaaagtgctgggattacaggcgggagccaccatgatggccaacttttgaattctgaaccagttgattgagtaccagagctcttcaataccttgaagaaagattcaggggagagccgttgtgaacagcttgccccagggaaaggacaaggctgagagaattccagggcttccttgagaaaacagaattgaggaaatgcaaagtgaagaattctagcatcaggaacaagagaagaatgatggaaaacctgctactgagatatgttggatattttgcacaagtgaaacatctctacaactggaatctccctccaagacggatactctttataataagattcattatttattcgattcgtgatactgcatgacattgaaacagctggtgtattaactaatgtatatgacagtccatctctgtacgatgatgtgaaagtgcagtttttctcttcggctttatctaccaagaaatgaattggataatccacatcaacaaaaagcatggaaaatttatccaccagaatttgccgtggagatactttttggcgagaaatgacttccaatgacgtagctggatccgattaagtatagtttccccttccccttctgggaaagaattaatgttctttccaacccctgccatgtgcatgttcatatgtcctaagtcttccttgatgatgtatctatatttatatatgtttatatatgttcttcataaatctattaaatatatatagata

SEQ ID NO: 80458 - DNA, 1912 bp, Homo sapiens
  misc_feature (450)..(450): n is a, c, g, or t
  misc_feature (456)..(456): n is a, c, g, or t
  misc_feature (458)..(458): n is a, c, g, or t
tgtccatttgtgtctccaccaatgaccaacactgtgttgggatccacagacttggggaagatgaacttaatagattaagaaaagatgaccactgcagctgcatttctattttggaatcacactctccgtgacctgtgtgagtcacagctaccagaaaacaaagacagcaaagaagagagaacaggaaatgagaatgggtgatgtgggtccccatgaagcaataaacataggaggacctcactctgttgtgcatgctggagtacagtggcgcagtctctgctccctgaaacctcgacttccagggctcaagagatccttccatcttaccaagtggctgggactacagatgtatagttattttccaaacccaccattgtaaaattacattctattaaagagaaaaagaagaaaaagaaacttaatttgttttttgggggatagttgagatgngtttancncagcccctgctggtaaccaaggtcctcctccaatgacgggtatgaatatgaacaacagagcaactatacctggcccaccagtgggtcctggtcctgccatgggaccagaaggagccgcaaatatgggaactccaatgatgccagataatggagcagtggaagaaccggaactatgatttgtgccttccttattgcctccgaaatatttttaactgcagaggaaagcctgtattattttggagaaaggcgaacagataaaacgcacagcagtaaatttcagggactagaaactccttctcagtagagacaaggtttcaccctgttggcgaggctggtctcaaactcctgacgcccagtgatctgcccacctcggcctcccaaagtgctgggattacaggcgggagccaccatgatggccaacttttgaattctgaaccagttgattgagtaccagagctcttcaataccttgaagaaagattcaggggagagccgttgtgaacagcttgccccagggaaaggacaaggctgagagaattccagggcttccttgagaaaacagaattgaggaaatgcaaagtgaagaattctagcatcaggaacaagagaagaatgatggaaaacctgctactgagatatgttggatattttgcacaagtgaaacatctctacaactggaatctccctccaagacggatactctttataataagattcattatttattcgattcgtggtgttggaacaggcgatgtatgtgatctaaaattccaaatagtaatggagaaaaaggttgtcttttccagtacttcattaggaaattgttcaatactgcatgacattgaaacagctggtgtattaactaatgtatatgacagtccatctctgtacgatgatgtgaaagtgcagtttttctcttcgaatcttcctaaatactatgacaattgttcatttttcttctggttcaacacatcttttattcaaaataacagagagaaatttagatattttattaaacttggaagtcattaatgccatataaagcaatgctaagagagtcagcatgtgttactgatgtgttgctgaagattaaagtatttttaagtctcaccaaaaaggtggaaggagccaactgagacacaaaaaaggggctgaggttctattcacggctttatctaccaagaaatgaattggataatccacatcaacaaaaagcatggaaaatttatccaccagaatttgccgtggagatactttttggcgagaaatgacttccaatgacgtagctggatccgattaagtatagtttccccttccccttctgggaaagaattaatgttctttccaacccctgccatgtgcatgttcatatgtcctaagtcttccttgatgatgtatctatatttatatatgtttatatatgttcttcataaatctattaaatatatatagata

SEQ ID NO: 80459 - DNA, 1736 bp, Homo sapiens
  misc_feature (450)..(450): n is a, c, g, or t
  misc_feature (456)..(456): n is a, c, g, or t
  misc_feature (458)..(458): n is a, c, g, or t
tgtccatttgtgtctccaccaatgaccaacactgtgttgggatccacagacttggggaagatgaacttaatagattaagaaaagatgaccactgcagctgcatttctattttggaatcacactctccgtgacctgtgtgagtcacagctaccagaaaacaaagacagcaaagaagagagaacaggaaatgagaatgggtgatgtgggtccccatgaagcaataaacataggaggacctcactctgttgtgcatgctggagtacagtggcgcagtctctgctccctgaaacctcgacttccagggctcaagagatccttccatcttaccaagtggctgggactacagatgtatagttattttccaaacccaccattgtaaaattacattctattaaagagaaaaagaagaaaaagaaacttaatttgttttttgggggatagttgagatgngtttancncagcccctgctggtaaccaaggtcctcctccaatgacgggtatgaatatgaacaacagagcaactatacctggcccaccagtgggtcctggtcctgccatgggaccagaaggagccgcaaatatgggaactccaatgatgccagataatggagcagtggaagaaccggaactatgatttgtgccttccttattgcctccgaaatatttttaactgcagaggaaagcctgtattattttggagaaaggcgaacagataaaacgcacagcagtaaatttcagggactagaaactccttctcagtagagacaaggtttcaccctgttggcgaggctggtctcaaactcctgacgcccagtgatctgcccacctcggcctcccaaagtgctgggattacaggcgggagccaccatgatggccaacttttgaattctgaaccagttgattgagtaccagagctcttcaataccttgaagaaagattcaggggagagccgttgtgaacagcttgccccagggaaaggacaaggctgagagaattccagggcttccttgagaaaacagaattgaggaaatgcaaagtgaagaattctagcatcaggaacaagagaagaatgatggaaaacctgctactgagatatgttggatattttgcacaagtgaaacatctctacaactggaatctccctccaagacggatactctttataataagattcattatttattcgattcgtggtgttggaacaggcgatgtatgtgatctaaaattccaaatagtaatggagaaaaaggttgtcttttccagtacttcattaggaaattgttcaatactgcatgacattgaaacagctggtgtattaactaatgtatatgacagtccatctctgtacgatgatgtgaaagtgcagtttttctcttcgaatcttcctaaatactatgacaattgttcatttttcttctggttcaacacatcttttattcaaaataacaggctttatctaccaagaaatgaattggataatccacatcaacaaaaagcatggaaaatttatccaccagaatttgccgtggagatactttttggcgagaaatgacttccaatgacgtagctggatccgattaagtatagtttccccttccccttctgggaaagaattaatgttctttccaacccctgccatgtgcatgttcatatgtcctaagtcttccttgatgatgtatctatatttatatatgtttatatatgttcttcataaatctattaaatatatatagata

SEQ ID NO: 80460 - DNA, 1072 bp, Homo sapiens
tcctctcactgatcaagaatgagattggagggaaggagaatttaaaacaaaggcaggagaaaaggcaggtctggccacttagagaaaccattcccagccacagaggccagatccagcagccgggggaaaggtcactgcagatgaaacactaaaactaagttcattgccaatactctcccccaagtccctcaagtttctgaatgcctaacaggcctgggtgtgcgtaaggggaaacaaaccagccaaccccacaagaggtgcctcctcccagcctcagtgcaaacagcgtctgggcagtgcctctgtttcctatgccacagggaatctcccaggacaccacctggccagccaacccagactcacccaccccataacccctagtctctgaggcaggctgccagccacactgtcttacaaaagggaaagagctgcttggaggagatcgcatactcaggaaaacccacctggctccaagcacgggccatgtttctgtaaaaggccattctccacttggagggtttgggggtgggtggacagccttaactgaaaggcatctgaactctgtcctgaggactcagatcaagcagaggctacagaaaatgacttgggaagacagagctcagcttcactcctaccaggagaaaaattatgaccatcctcaccctgacaggcttgtcccttttacaaagccctctgatccccaaagtcacctccttggccttttacacttaagaacaaggattagagcagtgggcaagggaagtaccaggatggaagtccaggagccctgcgtcctggggcttggaaactgctgagggagaaggacatgttcgagtcatggcttcaaggcttattagtatatgaccttgaccaacagccatacctgtcctggacctcacttttgtcatctgtaagatgggaacatacagtattagactgaactatatgaaactgttgtttttgcaggtcataaacaattgaaaattggcaatttcatatgactcaacataatgcgcacctaatcagcttggaacctccctagctgagaaaggacctaacagacgaccccgtt

SEQ ID NO: 80461 - DNA, 746 bp, Homo sapiens
aacattgtaagaaactgcctgtttccaagtgtttgtaccatttttcattaccaccagtaatgtatcactgtttcatcctccacaacctcgacagagcttggtataatctgtctttttaatttttttaattctcacaggagtttagtaggatctcattgaaattttcatttacatttcccttataacgagtgatgctgagcatcatttcctgtgcttacatgatatttgtatgtcttctttagtggaatgtctattcaaatattttgcctgtttctttactggtgtgtgttttcttcttactaagattttaaacatattctggatacaagtcctttattaaatatataattttcaaacattttaccccggtcagcagcttacttgtctattttttcaaccatgtagttggaaagctaaagtttttaactttgaggaagtccaatttttcaatttctttgcttatagattgtggttttgttgtctcatctatgaaatcttcacctgacccattgtcaaaaagattttctcctgttttttttttttctgctagaagttttatagcatcaaattttatatttagatctcaggtccattttgaatagacttttgtatatagtgtgatatctgagtcacagtttatatttgtgcatgtcaatattcacttgtcccagcaccatttgttgaaacaataatcctttctccactgaatcaccattgcatctttgtcaaactcagttgtccatata

SEQ ID NO: 80462 - DNA, 1283 bp, Homo sapiens
tagtaatttagcaaaaacattactgttctaatgctgaagtgacttttgccagtgccatgtccaggtggtgaggtataagttacttgctcttagcatttggtctgatttttttgctttgtggacacctttgagagtatccacaaagcaatgtctcaggtgtggacacctgagagcatgttttagaaagctttgtaccctgtcttgtggcaggaaagaaagaacaggggttttacataaggaaataagtcctaggaaattagtcaacgcaaattgcatttgcgtttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaatgttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaaacacaaaacagaatgttaaaaaatgtatgcagatttatggatattatcaatgagaagacatagcatgtaacttctcctatatctctactgtccagcatgtattgttccaaatatgactccctaaaatatatacactttgcagaagctctaggccctcacctcaaaccttgccattggttgccgtatttcaaggtcaatatagtttccctcactttacacaatcattattcttcaatagtggaccatatccttcaccaggtatcctatttctgttatctagaggttagcagaaaatgaaatgaaggaatttccctaagcagttgggaagaacaaattgtatgcatgtaggcaaagattttgaagatacatttgcaagagatatttgtttaaccaaaatatttggaaagtaacaaataaagacatttaaattttctaaaaatggacttgctcttctaggaaaagaatacccctggggcaaaaatataactctagctgtatttcttcttgtcactcttgattcaacttgattataaatacacctgtcactaccagaacca

SEQ ID NO: 80463 - DNA, 469 bp, Homo sapiens
  misc_feature (8)..(8): n is a, c, g, or t
  misc_feature (41)..(41): n is a, c, g, or t
  misc_feature (49)..(49): n is a, c, g, or t
  misc_feature (67)..(67): n is a, c, g, or t
ccccgggngtccatttggtaaatgtgttgccctggaacccncccccctncctagcctaacccctcanaccttacgagacatgtcctgagggtgaaaatgccagtaaaataaaaatcctgtttttttaaagaagagatcccacaatgtcctggtgtttccctaatgtaaacaaaatgatcagatttgatgtgttagaactccctaagcattttgaaggaatttccctaagcagttgggaagaacaaattgtatgcatgtaggcaaagattttgaagatacatttgcaagagatatttgtttaaccaaaatatttggaaagtaacaaataaagacatttaaattttctaaaaatggacttgctcttctaggaaaagaatacccctggggcaaaaatataactctagctgtatttcttcttgtcactcttgattcaacttgattataaatacacctgtcactaccagaacca

SEQ ID NO: 80464 - DNA, 697 bp, Homo sapiens
aatctagcaggatcccctattggtgcacgagaggaaaaagtgaacagtacattggatctgaagtacaaccacccacaaccataccataaagtaccaagggtagagaagtttctcctcctcctcaaaagtttgtgtggttggctttcttctagaatgttggatttccagaagcccactcaaatgtcccactttggctacaggcattagaatttcagaaccagcaaaatccaaaggggcaagagtcccaagtagaggcaatgtattcataaaccaggcactagccattattcatggaagcaaagggaatagttttttgatcgtccaacctatattggttgaatgagtaggctgaggacgatcatttatcatctagactcacatttgtctccttcctgatagcagttaagaaaaaattctaaccacacaatttgtatattgtttttctccgtattatgttaagcaaatgttcactgcagtaaaatgttttggaaattagctttgtcttatttccagtttagttcagagaattaattggaaacctgatttcttttacacataaacctgacaaaaaatgtagcttagagcaaagggtgaatgtttgcttaactcctgcttacttctcaagtacatgaaaactttaatagaatatgccagtattcactgagtttttaaaaatattaccatgtgtaaacatata

SEQ ID NO: 80465 - DNA, 1926 bp, Homo sapiens
tagtaatttagcaaaaacattactgttctaatgctgaagtgacttttgccagtgccatgtccaggtggtgaggtataagttacttgctcttagcatttggtctgatttttttgctttgtggacacctttgagagtatccacaaagcaatgtctcaggtgtggacacctgagagcatgttttagaaagctttgtaccctgtcttgtggcaggaaagaaagaacaggggttttacataaggaaataagtcctaggaaattagtcaacgcaaattgcatttgcgtttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaatgttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaaacacaaaacagaatgttaaaaaatgtatgcagatttatggatattatcaatgagaagacatagcatgtaacttctcctatatctctactgtccagcatgtattgttccaaatatgactccctaaaatatatacactttgcagaagctctaggccctcacctcaaaccttgccattggttgccgtatttcaaggtcaatatagtttccctcactttacacaatcattattcttcaatagtggaccatatccttcaccaggtatcctatttctgttatctagaggttagcagaaaatgaaatgaaggaatttccctaagcagttgggaagaacaaattgtatgcatgtaggcaaagattttgaagatacatttgcaagagatatttgtttaaccaaaatatttggaaagtaacaaataaagacatttaaattttctaaaaatggacttgctcttctaggaaaagaatacccctggggcaaaaatataactctagctgtatttcttcttgtcactcttgattcaacttgattataaatacacctgtcactaccagaaccaaaaaaaaaaagaaaaaaatcccaagcacaaagcttattttatttgaaaaaaataaaaaagaaacttcaacactatgggacactggctcttttagcatgaaatgacttgagcttttgtagtgatgatacacacacatacacactcatcagtaaaacgatggtttcataaataacacaattgatgcaaatcataaaaatcaattacaattatgatttcatgacaaaatatatttaattaagtttgttatgaaaaaaatagagatatgaatcactaacaaaattcctccattttcagtggctattcatcatttatcatctagactcacatttgtctccttcctgatagcagttaagaaaaaattctaaccacacaatttgtatattgtttttctccgtattatgttaagcaaatgttcactgcagtaaaatgttttggaaattagctttgtcttatttccagtttagttcagagaattaattggaaacctgatttcttttacacataaacctgacaaaaaatgtagcttagagcaaagggtgaatgtttgcttaactcctgcttacttctcaagtacatgaaaactttaatagaatatgccagtattcactgagtttttaaaaatattaccatgtgtaaacatata

SEQ ID NO: 80466 - DNA, 1299 bp, Homo sapiens
  misc_feature (462)..(462): n is a, c, g, or t
gctttagggtagaagaaaaggttttatttttctttctcacattggaaaaaatgaaaactttcggacccatgaaattttattacattttgccaaaaacagaaccaataacataagtattcaaagttatgtaaagataattatttaatattaacattatgatggtgagagggaccacggagcaaggggctgccttgcaggcctgccttccagctttgctacagggaccagaagcgggagctgagcgcaggggaggcaggcggaggccatgggcagcgaggcgggtgcgccaaagggcgccagttccggagctgctgggcctgggctgcaggagggcggagctggggccgcaaggctggtgccggccgacaaacgacgcggcgcgggcgagtgggcggaggcggctgcggagaaggctgggctgccgcgggacgcggtgaagatagcctgcggagtgtccgggcngaacacggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctctgcagccgaagccatatggtgtcaccagtgcacgggcttcggagggtgctcccatggatccagatgcctgagggactccacccactgtgtcaccactgccacccgggtcctcagcaacaccgaggatttgcctctggtcaccaagatgtgccacataggctgccccgatatccccagcctgggcctgggcccctacgtatccatcgcttgctgccagaccagcctctgcaaccatgactgacggctgccctcctccaggcccccggacgctcagcccccacagcccccacagcctggcgccagggctcacggccgcccctccctcgagactggccagcccacctctcccggcctctgcagccaccgtccagcaccgcttgtcctagggaagtcctgcgtggagtcttgcctcaatctgctgccgtccaagcctggggcccatcgtgcctgccgccccttcaggtcccgacctccccacaataaaatgtgattggatcgtgtggtacaagcta

SEQ ID NO: 80467 - DNA, 688 bp, Homo sapiens
gagggggttgggaagctcgaagccgcaggcctgactctggcctttggcatcctggggttggcctgggcaaatgtgtcgtgagagacggatttgttgttctcgggaaggcggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccaccacctcctgctgccagtacgacctctgcaacggcaccggccttgccaccccggacaccctggccctggcccccatcctcctggccaccctctggggtctcctctaaagcccccgaggcagacccactcaagaacaaagctctcgagacacactgctacaccctcgcaccc

SEQ ID NO: 80468 - DNA, 344 bp, Homo sapiens
  misc_feature (318)..(318): n is a, c, g, or t
  misc_feature (320)..(320): n is a, c, g, or t
agtcctgccatggccagccatccggcccccagggccctgcttgggatggggctgcagaccacctcccatgggacctctgcaccaaccatcccctggggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccagncnttggactcacgtgtggccggcacc

SEQ ID NO: 80469 - DNA, 612 bp, Homo sapiens
aggtggggccggggcaggcctggggcggggcctgcggtgagctcgcgctgggcgggctgttccgggggcgggactgggctgggcctgcggtgagcatcaggcgatgcggcacgggtgctgcgggacacacagacacgcctacgattagactcaggcaggcacctaccggcgagcggccgcgggtgactcccaggcgcggcggtacctcacggtggtgaaggtcacagggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctgggtaagatggacaaaggacagagggatgggcagacccactttgagggcagatgggctgacagtagggaaggaggctagaattcccagcgacaacccctccttctagccccctgccccggggaaggtgacgggctgggggcctgatgggctggaggaggggcctctcatgt

SEQ ID NO: 80470 - DNA, 426 bp, Homo sapiens
ctcggtctacctgttctcacttatcctcttgccaaactcgtgtgatatgtgtgcgtcattcacctattttccatcttcgccttctcacatagctcaatgagcgctgtgggagaaagccccgaagcagcccttggcatggtggtcactgcatgaccacgcgcacctactacacccccaccaggatgaaggtcagtaagtcctgcgtgccccgctgcttcgagactgtgtatgatggctactccaagcacgcgtccaccacctcctgctgccagtacgacctctgcaacggcaccggccttgccaccccggacaccctggccctggcccccatcctcctggccaccctctggggtctcctctaaagcccccgaggcagacccactcaagaacaaagctctcgagacacactgctacaccctcgcaccc

SEQ ID NO: 80471 - DNA, 478 bp, Homo sapiens
gagggggttgggaagctcgaagccgcaggcctgactctggcctttggcatcctggggttggcctgggcaaatgtgtcgtgagagacggatttgttgttctcgggaaggcgtaagtttaatttagtcctccaggacggagaccgagggccgagtatcccggcaggggtaggagagccgtaatccaacccccacctccccactgtaaacctctttccagagagggcattcccgttccaaacaccagacccagccggggaaatgcttcttcttgtctggcccaagtgccctcctgggaggggctcaaaatgcattccccccaagctgggcacagctcatccctgctggggagcttctgcagtggccgaggactcagacaaccctaaccagggctctggaggtcttctggaagaaggaaccccaagtagggacaccccaggagcagagaggaggggaacagcgagaagagacccagcttttg

SEQ ID NO: 80472 - DNA, 400 bp, Homo sapiens
cactgggctcctgctggccgccgtcctgagcctgcagctggctgcagccgaagccatatggtgtcaccagtgcacgggcttcggagggtgctcccatggatccagatgcctgagggactccacccactgtgtcaccactgccacccgcccccggacgctcagcccccacagcccccacagcctggcgccagggctcacggccgcccctccctcgagactggccagcccacctctcccggcctctgcagccaccgtccagcaccgcttgtcctagggaagtcctgcgtggagtcttgcctcaatctgctgccgtccaagcctggggcccatcgtgcctgccgccccttcaggtcccgacctccccacaataaaatgtgattggatcgtgtggtacaagcta

SEQ ID NO: 80473 - DNA, 1047 bp, Homo sapiens
  misc_feature (462)..(462): n is a, c, g, or t
gctttagggtagaagaaaaggttttatttttctttctcacattggaaaaaatgaaaactttcggacccatgaaattttattacattttgccaaaaacagaaccaataacataagtattcaaagttatgtaaagataattatttaatattaacattatgatggtgagagggaccacggagcaaggggctgccttgcaggcctgccttccagctttgctacagggaccagaagcgggagctgagcgcaggggaggcaggcggaggccatgggcagcgaggcgggtgcgccaaagggcgccagttccggagctgctgggcctgggctgcaggagggcggagctggggccgcaaggctggtgccggccgacaaacgacgcggcgcgggcgagtgggcggaggcggctgcggagaaggctgggctgccgcgggacgcggtgaagatagcctgcggagtgtccgggcngaacacggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccaccacctcctgctgccagtacgacctctgcaacggcaccggccttgccaccccggacaccctggccctggcccccatcctcctggccaccctctggggtctcctctaaagcccccgaggcagacccactcaagaacaaagctctcgagacacactgctacaccctcgcaccc

SEQ ID NO: 80474 - DNA, 806 bp, Homo sapiens
aggtggggccggggcaggcctggggcggggcctgcggtgagctcgcgctgggcgggctgttccgggggcgggactgggctgggcctgcggtgagcatcaggcgatgcggcacgggtgctgcgggacacacagacacgcctacgattagactcaggcaggcacctaccggcgagcggccgcgggtgactcccaggcgcggcggtacctcacggtggtgaaggtcacagggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccaggccttggactgccacgtgtgtgcctacaacggagacaactgcttcaaccccatgcgctgcccggctatggttgcctactgcatgaccacgcgcacctactacacccccaccaggatgaaggtcagtaagtcctgcgtgccccgctgcttcgagactgtgtatgatggctactccaagcacgcgtccaccacctcctgctgccagtacgacctctgcaacggcaccggccttgccaccccggacaccctggccctggcccccatcctcctggccaccctctggggtctcctctaaagcccccgaggcagacccactcaagaacaaagctctcgagacacactgctacaccctcgcaccc

SEQ ID NO: 80475 - DNA, 554 bp, Homo sapiens
cactgggctcctgctggccgccgtcctgagcctgcagctggctgcagccgaagccatatggtgtcaccagtgcacgggcttcggagggtgctcccatggatccagatgcctgagggactccacccactgtgtcaccactgccacccgggtcctcagcaacaccgaggatttgcctctggtcaccaagatgtgccacataggctgccccgatatccccagcctgggcctgggcccctacgtatccatcgcttgctgccagaccagcctctgcaaccatgactgacggctgccctcctccaggcccccggacgctcagcccccacagcccccacagcctggcgccagggctcacggccgcccctccctcgagactggccagcccacctctcccggcctctgcagccaccgtccagcaccgcttgtcctagggaagtcctgcgtggagtcttgcctcaatctgctgccgtccaagcctggggcccatcgtgcctgccgccccttcaggtcccgacctccccacaataaaatgtgattggatcgtgtggtacaagcta

SEQ ID NO: 80476 - DNA, 842 bp, Homo sapiens
aggtggggccggggcaggcctggggcggggcctgcggtgagctcgcgctgggcgggctgttccgggggcgggactgggctgggcctgcggtgagcatcaggcgatgcggcacgggtgctgcgggacacacagacacgcctacgattagactcaggcaggcacctaccggcgagcggccgcgggtgactcccaggcgcggcggtacctcacggtggtgaaggtcacagcccaggccttggactgccacgtgtgtgcctacaacggagacaactgcttcaaccccatgcgctgcccggctatggttgcctactgcatgaccacgcgcacctctgcagccgaagccatatggtgtcaccagtgcacgggcttcggagggtgctcccatggatccagatgcctgagggactccacccactgtgtcaccactgccacccgggtcctcagcaacaccgaggatttgcctctggtcaccaagatgtgccacataggctgccccgatatccccagcctgggcctgggcccctacgtatccatcgcttgctgccagaccagcctctgcaaccatgactgacggctgccctcctccaggcccccggacgctcagcccccacagcccccacagcctggcgccagggctcacggccgcccctccctcgagactggccagcccacctctcccggcctctgcagccaccgtccagcaccgcttgtcctagggaagtcctgcgtggagtcttgcctcaatctgctgccgtccaagcctggggcccatcgtgcctgccgccccttcaggtcccgacctccccacaataaaatgtgattggatcgtgtggtacaagcta

SEQ ID NO: 80477 - DNA, 360 bp, Homo sapiens
gggttaggtctgtcttcctgctactcacaagggaagacactgggagccacctggaaaagacagatgtggaacaaggagaggtgacccctgagagttctcacttcaccctggcgtgggtcatgacctgtgtcactctggcactctcaaggcatcaacacctaccccacacttgggaagagtcaaacgagctcccccaggcctgacctcatgaagactaatgaaactaatgaagacaaagtttcctggagtttatgtggccacacaaaagcacatccacagccaattatgtcattatgcaatagtcatgtttaataattggaaccattattgaataattaaacttcaccacatgttacagcc

SEQ ID NO: 80478 - DNA, 171 bp, Homo sapiens
ctttactacggtactcctcaaagagtgcaattatccccttgcagtttctacaaaaagagtgtttcaaacctgaactatcaaagaaaggttccacactgtgagttgaatgcagacatcacgaagaaggttctgagaatgcttctgtttagttctgtgcagtttatcccgttt

SEQ ID NO: 80479 - DNA, 354 bp, Homo sapiens
ggtggaactgagctgttgaactgagctgaactgggatcaggagaaggagaagtggggattgagcccctcacctccacacactcctctctgtgcctgaaattcctccattaagcagcatcgctgtcccctgtaaacacccacattaagccattattcatcttatggcttgagtaggcgttagtccctcagatcctttcctgctgaaagcaggatctgatagagagaagggaagagagatggatggatctggggacggcaggctggtccaagagtggggaggaaagatgtctctcggactctgggaaagaaatattttctgggggaatgtggaggcaccagaggcaagctcagagg

SEQ ID NO: 80480 - DNA, 237 bp, Homo sapiens
  misc_feature (99)..(99): n is a, c, g, or t
gacgagatccagttcctgcgaactgatgatgaagtggttctgcagtgcaccgcaaccatccacaaagaacaacagaagctatgcttggcagcagaaggntttggcaacagactttgtttcttggagtccacttccaattccaagaatgtgcccccagacctctccatctgcacctttgtgctggagcagtccctctctgtccgggcgctgcaggagatgctggctaacaccgtggaa

SEQ ID NO: 80481 - DNA, 394 bp, Homo sapiens
tatcagaaatgaccagattgtgtggggttgtgagaactgactttgatttgccaaacttcacgctgatgtatgtatacaaaatgacagtttatttatttattatggaatagagacattttcagtgaccagaatactcagacctgtatctactgtcttctagaatgacagtatctggagggttgaaataatcagaaaatggaatttttaagggatggttcaactagtctgtggaaaaacctaataaactaccagtgtcacacaatagaggacatttctgtgatgaccagatgatttatctattcattttcacttttttttttttttttttaaagatggagtttcactctgtcacccaggctggagtgcagtgacacgatctcagctcactgcaacc

SEQ ID NO: 80482 - DNA, 566 bp, Homo sapiens
cgggcaggtggctgagggtggcccgtgttcgtctttcccagctttgtggaggtgtagctgggcctgtgggcacacggacgccctccctattgcgctgatgggcccggggacggtccctgtgtccctggagctgacagagccgccatgcgcggccgaggactctgcggattcaccctgttccaggctgcgccgactccgctcgcttcacgtgtgctgtttcctcacaagtcgggccggacgcggatacacccgcctccgtaggcctgagcgagcctgagcccctgggcgcgccgggtccccgccgaggaaacgtcccatgtggagacacgaggctgctgtggacgcgcctcctccctcttccccggcgcggctcccccgcactggcgctgtggactcggtgcggctcctccgcagcgacaaaatggagtcatcaggccacgctgctgcgatggaacccgaggcctgcggggccggcagagcccgcggcgtgttggccctgctcctcagaggggccggtgaggggcctgtctccccggggtgggccggagccaggatgaccgagcatc

SEQ ID NO: 80483 - DNA, 422 bp, Homo sapiens
taccgttatgtattttactagagatgggtctcaccacatgggccaggctgtctcaaaaaactcctgacctcaggtgatccacccaccactgatctcggcctcccaaagtgctgggattacaggtgttagccaccgcgcccggccttgctataccttttaagctcagtgaactcttgaattctctagcctttaacatcgttcgttaaaaagaattcttattttgtttatataccgctatcatttctagcaacataatacacagatttgaaatgtaaatgaaatgtttgttgcattgcaaatacaaacctataatcacatgactcttctttcatatcagttttccttaagttatttcagagaacacatagtctaatagatcattttgttgactttctgggttctccggggccaggctttgtcaa

SEQ ID NO: 80484 - DNA, 293 bp, Homo sapiens
tggggccagcccggctgcaggagcccctccttcactgcagctgtgctgttcctgtgcacccccgggggcctggcctgagacagataagatgacccattttggtaaaagaggcgtgtggaaaacatcagaccacccccttctctctccagtctaaggtagcacgttttacagtttcatattacaagtcaccttgcacaaaatccttacctaagcacgcatctgtgcacacatctgtgcttagctccctgctgggagttcgggatctcctgttaaatacggatgcacagtgtatc

SEQ ID NO: 80485 - DNA, 460 bp, Homo sapiens
tcagacaagatgcctatgtgaaaagttaatatcagaggcatttgggctccttgtactttcctgtagtagtcacgggcccatagagtcttagatgtggaagggccctcaggaatcgtctaggcctccccgtccccttacagggaaacctctgtgctattgctggccagatactctacagacctctcctggaatacagttacctgttccttgaggctctttcaatctactgtctattgtttcaccagctttaattgttggagaaaaatcctttctcatactgagctgaaatctgccacatgtaacttccatactttggtccttgttctgccctttgaagaaatattaactgaatctagtcccacatggcaccccttcaatacttgaaagtagtgtggtcctagttaagtcttctgtctcctttccaaccccccaaatcctttcttgcttcttactggaaata

SEQ ID NO: 80486 - DNA, 256 bp, Homo sapiens
taatatgtatcacaaaaattagtataaagaatcaatatcctttgcctatgttatcagctctgacttttccttttaatgccattttgaagcaatcctgatttctaattataagacccatgaagctctgtgttgcaatataaatttgtggaatcatctagcatgctctcaataatggacaacatgagtcaagttaaaaattataccctaaacagtaatggaataaaaataaagaataggaatggtaaaatatctaaat

SEQ ID NO: 80487 - DNA, 240 bp, Homo sapiens
ggtttagagcacagcctccctctccagggtcaggttcacgggagctgttgggggctccttccctcgcagcagtgaccactccaaggaccacggcctggacatgagcggcagcggtgagctgggagctgctggcctggagtctagatgaatataggcagcagcaagaggccacagtcacgacaaacctacacactctcaccactgtcatctcatattgtcctaaaatttccagccagtgca

SEQ ID NO: 80488 - DNA, 323 bp, Homo sapiens
gggagacgagaactcttgagatccggggtcacctgtgagtcgctggacccaagggggaagcgtcttgattcctggaggaaatctccgaaggtgatgtgtaaccctgtgtgtcgcctgcacttcggccgcaactgcctttggttcagtcccctgttcctgtaggaggcggggatcatgtaacagtggagcacatcgctcccggcttggacgcctttgacctttaagtgttcctgatttagttggctttgggtctaccaagaattctagtcagttaactagcttttaagccaggttctgaatttgtaggcatgacactccagtag

SEQ ID NO: 80489 - DNA, 881 bp, Homo sapiens
gtcccgtcagtattgtggaagctttgttcttttgctttttgcagtaaatgttggtgctggtcactctttgggtctgtgctgcctttatgagctgtaacactcaccacaaaggtctgcagcttcactcctgaagtcagcgagagcatgaagccaccgggaggaaagaacaactctggacgcgccaactttatgaactgtaacactcaacgcaaaggtctgcagcttcactcctgacgtctgtaagaccatgaacccaccagaaggaagcaagtctggagatgtccgaacatcagaaggaacaaactccagataaaccgtctctaagaactgtaacactcactgccagggtccgcggcttcattcttgaagtgagcaagaccaagagctcaccaattctggacacagcaccattattcacaacagccaaaaagtggaaacaattcaaatgtccatcaactgatgaatggataaactgtggtatatccatagaatagaatattattaggtaataaaaaggacttaagtactaacataagctttaatgtggatatcccttgaaaatattgtaaatgtaagaagccagaaacaaaaagccagatgattccgttcatatgaagtgtccagcatagacaaatctgtaaagatagaaactagattcatggtttcttagggccgggagagtaggtgggaaggtggggcaatgggaaatggctattaatgggtataaggtttcttttgagggtgatgcaaatgttgtaagattgattgtggtcattgttgtatagcatatgattatactaaaactattgacttgtatactttaaataggtggctgtgtggtatgttaattatatctcaataaaattaaaaataaaaccagc

SEQ ID NO: 80490 - DNA, 304 bp, Homo sapiens
attagccaggcatagtgatgtggccctgtagtcctagctagccaggaggctgaggtgggaggatcacctgagctggagaggttgaggctgcagtgagctgtgatcatgccattgcactccagcttgggtgacagagtgagaccctgcctcaaatttaaaaaaaagatcagcagagatatgtaacagatttcacaggaaggattcagcaagtcttctgtgagtaggtgacatttgagccaagttttggaggatgagtacagttggctttctgtatgcatgggttccacaccttggattcaaccat

SEQ ID NO: 80491 - DNA, 724 bp, Homo sapiens
ggcattcattcctgcaattttttttttttgagacggagttttgctctttttgtccaggctggagtgcaatggcggggatcttggctcactgcaacctccgcctcccgggttcaagccattctcctatctcagcctcccaagtagctgggattacaggcatgcgccaccatggccagctaattttttgtatttttagtagagacggagtttcaccatattggtcagctggtcttgaactccagacctcgggtgattcacccacctcggcctcccaaagtgctgggattacaggcatgagccactgtgcctggcctgcaattttttttcatgaccacaaagttacctcttcctgcttgaccaagaaacagcacatcagcagtttatattgtgggaacaaggaatattgggcaaaaagtgagtggttagcacgtgcaagcaagcatcggcctgatcagaattttttttctttttttttttctttttgacaaggtctcattctgtcacccaggctggagtgtgaaggggtgggttgcccctccacacctgtgggtttttctcgttaggtggaacgagagacttggaaaagaaagagacacagagacaaagtatagagaaagaaaaaagggggcccatgggaccggcgttcagcacacggaggatccccccagcctctgagttcccttagtatttattgatcattattgggtgtttctcggagaggggg

SEQ ID NO: 80492 - DNA, 346 bp, Homo sapiens
caggcaagtttcttccaggatgagaaatcagtggaaagtgagggccagccaacagccaccaccaaccacccaacacgcgagcgagaccatcttaaaagagccccagccaagctgaccatgggtctgaccccaaactgaagaaatgcccagcccagccaaacccaaattgctaacttgtattataagcaagtacaatggtccttaccttaagccactaagttttgggatgctttgttacacagctatagatagctgatacagggaatgtcagaatccatgatgagagaaccgagcctttcagtctgtcagaggcaccctcgctggcaaaacttcaaaagaggcacct

SEQ ID NO: 80493 - DNA, 331 bp, Homo sapiens
ggaaaaccagagacctttgttcacttgtttatctgctgaccttccctccactattgtcctatgaccctgccaaatccccctctgtgagaaacacccaagaatgatcaataaaaaaaaataaaaaaaaagaaacagggaaatttacataaaaatgtttcataccatgatacaagtaaattctaaatttaaaactttttcaacaaagtaagtaggcaaaaggtttgtaaactacacttactattcaataaagccatcaaaaagtcactaaatggcaacaactttattatttatttataataactagtagagaggcagcatggttcagtttact

SEQ ID NO: 80494 - DNA, 523 bp, Homo sapiens
tattcagcaccatgtgaatctgtctacccatctcactaatctatatgtagcctaccactgtaatatttaaccacctgaaaatgcaggcatagtggtttcagaataagaaacacacaaccccatgagaaacacccttaccacctgtttatgtataccaactgcttatgtataaatcctttagcctttagacagaatctgcacttattatgcaagttgcttaggaaggcttatttttccccttccttcagtggattatttcatagatttgtataaagtattttctctgcatttcttcctggactgttcctatctactaaataagttattttgttaatttacatacttttagcttcactctttgtgttataaagttttctgggagttgaaaaactgtaccttttatccacgttacagtagcatacataataatatacaaagagaaattttctatctttacagatttgtctttcctttttgctgagacccgggtaaccaataaactctttactgtctttatacttat

SEQ ID NO: 80495 - DNA, 696 bp, Homo sapiens
gcagccctcagatgggaaaggaggggcttggggctctgagcttccctctgaggcaggctgtccctcagggtgaccagactgccaggcagccccggttgaggaagggtgtcttctcgtccgtcctccacgaagagtcctggggctgcctctgattcgccacgtgctcgtccccaaaccagtcgctggctgggagggggaggtgaacatgctgactggccaggctaggagttggagctggctcagcccccagggtcagggctggaggaccccccaggaccaggagctggaggggcgggagaccagggagcgagggtcagggcgggaggaccccccaggaccaggagctggaggggcgggagaccagggagtgagggtcagggcgggaggaccccccaggaccaggagctggaggggcgggagaccagggagcgagggtcaggtcgggaggaccccccaggaccaggagctggaggggcgggagaccagcgagtgagggtcagggcgggaggaccccccaggaccaggagctggaggggccggagaccagggagtgagggtcagggcgggaggacccctcaggaccaggagctggaggggcgggagaccagggagtgagggtcagggcgggagagacccccaggaccaggagctggaggggcgggagaccagcgagtgagggtcaggacgggaggaccc

SEQ ID NO: 80496 - DNA, 374 bp, Homo sapiens
aaacgaggagaggcgcctgccactctagcaaagagaatttccagctctgcgtctccagggagtaagaaaagagaaatggaaaatagaaaacaaagctggctgcttcaacagtaactcagtgctctccataacagcaatcccatgcatggtctccagaggtacatctcagttcccttttcaatacccaaagcaattttcctgagagattggaaaatcaggaggaggcaagccgatgacattttgattgcaggccccactcggagaggcattgtggaactttctggttaacaaagttaaaaccaaaacaaagtaaatgacgaatccaccacctcaaaaaaaaaaaagtcgacgcggccgcgaatttagtagtagta

SEQ ID NO: 80497 - DNA, 788 bp, Homo sapiens
aaacgaggagaggcgcctgccactctagcaaagagaatttccagctctgcgtctccagggagtaagaaaagagaaatggaaaatagaaaacaaagctggctgcttcaacagtaactcagtgctctccataacagcaatcccatgcatggtctccagaggtacatctcagttcccttttcaatacccaaagcaattttcctgagagattggaaaatcaggaggaggcaagccgatgacattttgattgcaggccccactcggagaggcattgtggaactttctggttaacaaagttaaaaccaaaacaaagtaaatgacgaatccaccacctcaatctgcattgtattttttgtttttaaagaaaatggtaaaacttttgctgctgcttttagtgactgagattttcaagagtggattgaagaaattattatcagtctgtttggcagctaagaaacctgctttgagatgggtagttgcttattaataatactgctttccacttcagcctcatctgtaaggcactgaactagctgctactgggtcttcaacctaccttcagacttctactgcatgaagtctttccacatctactgtgagatggatcacttcttctccgttcccagcactttttgggtatctctcctatgtcataggagagacattacatctatgtaatagatgtaatgatgttgtacaaggctgagcaacctcagccttgctctaaaattatttacatcatagtttaccattctttgagggtggcactttgcatttcatagaataattga

SEQ ID NO: 80498 - DNA, 358 bp, Homo sapiens
aaacgaggagaggcgcctgccactctagcaaagagaatttccagctctgcgtctccagggagtaagaaaagagaaatggaaaatagaaaacaaagctggctgcttcaacagtaactcagtgctctccataacagcaatcccatgcatggtctccagaggtacatctcagttcccttttcaatacccaaagctccacattttctgtactggctacactctcagacagtctctcctctcctggaagcaggatgactgcagcatctccagcataaattgttcttggttcaagtttaactgcagaagaaaaaagcaccacttcctgaaagtcccaaataaaccctggaattcattttgttag

SEQ ID NO: 80499 - DNA, 875 bp, Homo sapiens
cttgtccctcagcagaaaattgagtaaaacctcttcattgccataaaatactaatatattaccaaggtttcctgttcacccccagagtacagaatgagacacactcaacaactaaaacctccctctaaactgcttaaagagtttattcctccatttttttttccttcggcattttctgtgaatatctgtatgagttaaatgcgtacttttctaacctttgttattttgaaagttattctgatattcctatccagttgtgcctcatttactagaaatttgctcacatggccaaatgatgtatccacagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttacctttacatgtttttcttttg

SEQ ID NO: 80500 - DNA, 848 bp, Homo sapiens
  misc_feature (683)..(685): n is a, c, g, or t
  misc_feature (689)..(689): n is a, c, g, or t
cttgtccctcagcagaaaattgagtaaaacctcttcattgccataaaatactaatatattaccaaggtttcctgttcacccccagagtacagaatgagacacactcaacaactaaaacctccctctaaactgcttaaagagtttattcctccatttttttttccttcggcattttctgtgaatatctgtatgagttaaatgcgtacttttctaacctttgttattttgaaagttattctgatattcctatccagttgtgcctcatttactagaaatttgctcacatggccaaatgatgtatccacagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaaggggtgaccatggtgataatacacgagaaaaaaagaagaaggtgtgnnnttgnatcttgaatggaaaaagccatttctccctattgagatactctagctgcacacagtacaagcataacagatctgaatactatctggttgttcaatagataagtgctctacctttacgatgatgtctacctgcatgtcacacacttgcattcatgatatag

SEQ ID NO: 80501 - DNA, 475 bp, Homo sapiens
gacggaggtgatgagggcggacatcccagcctcctttctgttcttagtgagaaactgttcagtcttccgccatcggttgtggggttttcatagatatcctgtattaggttagggaagttccctctattcctaatttactgagtgatgttttttaaacaaatcaggaaccgacgttggatttttcaaatgctttttctgtactgttaaaagaaaaaccttagacaaattaaatttaacagagtttaattaagcaaagaaccactcgctaatggggcagcccccaaaccaaaataggttcagagaggctctggtgctgccgtgtggctgaagattggtggacagaaaagggaaaggaggcacagaaaacggaagcaaagcacagaaaccgccagaggggctgcagctccatgcttgccttatctgaacacggttggaatggccggcacccttgatgagcggaaacctggtgagtggc

SEQ ID NO: 80502 - DNA, 510 bp, Homo sapiens
ctggccaggtctctacctttaggagaagcaaagcaatggtttgtggtcagtataatcatagttgttcttctgagccattgttatttcttaccttgtggacatggtcaggcctgtgccccaacctctttttactgctgcctgctaggaaagcaccaagctcacgggtctacacccctggcaaggagacagtgcacctcgatgtttactttcagtactaaatacaccgacagggcggggtgtagttggctcatgtctgtaatcccagcactttgggaggctgaggtgggtggatcacctgaggtcaggagttcgataccagcttggccaacatggtaaaaccctgtctactaaaaatacaaaattagccgggcatggtggcgcacacctgtaatcccagctactcaggaagctgagacaggagaatcacttgaacccagggggcggaggttgtagtgagccgggactgtgccactgcactccagcctgggcaacaagagcgaaactctgtca

SEQ ID NO: 80503 - DNA, 342 bp, Homo sapiens
tgatatgttttgagattaaagcaacattaaaatcatatttataaatgttaacatatatgaaggagattgcctgagagattttgccagccttcctgaaaaaacgccaatggatgagctatccatcttagaaaattttaggttaacataaaatggtatgtaagcacaaatggaggcaacactttggttctatttctacaataaaagttttagaattacttttctatttttatatgctttataaaaaataaattacacaatagagggtaaaatagaatttaaacttatatgtatgcaaagcaccataaacaaaactaagtaaaaaacccagagcaaatgtcttta

SEQ ID NO: 80504 - DNA, 604 bp, Homo sapiens
ttttacggagacagggtttcaccatgttggccatgctgttttcaccatgttggccgggctgttttcgaactcctgacctcagatgatccatctgcctcccaaaatgctgggattacagacgtgagccacctcacccggccctactattggatttttaaagacagatatttaagaacattctttgctagaactgaggacaatttaaacttattccattcaagaaaacttagtgcagaatgcagactttccctttcaagtatatgtaaaagttaacttctttttttttccacctctggaagacaatgtacaatgtagtactcttcagatacactaatgagaccctttttatactttaacagggacgtaaacatttccttttgtaacaaaaataaattatgggtttcattttaaaaagcctatccccaagaaatgttttgagtgttaatctaagtaagatttcattattctcataagtaaaactttgagttcaaataaagttttgattttttttttgataattgaaggtatatgtaggggctcaacctaaatgccagggaattaaccctccataggaagtaatcatataattctaagtcagtatata

SEQ ID NO: 80505 - DNA, 266 bp, Homo sapiens
tgggtttctctgcaacatgtgtcaaattcctgtagtgcccaggacacagtagatgctcaatatgtggtggctctgattactattattggtgttgtttgtagaaaattgggctttcgggtccatcccactggtggcttgtgcctgggagtttttggcactcagagaaactgtgggagacctttagctgttgagaccagtcatggatgtgtgtgacacatagggtctatggtgacttctcagcagatgataaagtggtgctgggtctt

SEQ ID NO: 80506 - DNA, 287 bp, Homo sapiens
tttccctaatgatttatatgatcaatcagtcaaatatttattgaattctagttctgagtccagtattgtagtaggtacttaaggcttgcatatactatagtatactgtactttatacttcattcagttcattacagaatctgcatatgtttataaaagaattgtttctttccttagctttacaagtaagaaaactttttaggaaggtaagattctcttcctcttttgttttagcctcttgattctgggaaatgttttcttatccttgccttatttctctattttcct

SEQ ID NO: 80507 - DNA, 3139 bp, Homo sapiens
agcggcttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgtgagtcccgcgggcggtgcgcctgggaggaagggggaggtcggaggagggggcaccgcggcgccgggtataaggagcaaaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtaca

SEQ ID NO: 80508 - DNA, 363 bp, Homo sapiens
taatcagcgttactggttcgcatgtccccagagaggcagggaggggagctgacgcctgtccctcttagacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctggtgagtcccaagagggtcagaggaca

SEQ ID NO: 80509 - DNA, 3057 bp, Homo sapiens
agcggcttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtaca

SEQ ID NO: 80510 - DNA, 3069 bp, Homo sapiens
ggccctcaacgtggtcgaagtggaggcctctcattcgcgcgtcgcggtgtgctattgtgtaatcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggtgagggcctctggagctctgccccggcaggtggcaggatgcacgcacaagggtgtgcacaggagggcagctgccttacagccagactttgacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtaca

SEQ ID NO: 80511 - DNA, 2906 bp, Homo sapiens
agcggcttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtaca

SEQ ID NO: 80512 - DNA, 4708 bp, Homo sapiens
agcggcttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaaggtgaggcctcaggggcagggtccccccatcttggcagccacctgtccagaagcccagtgtggggacccactctcaccaccagggatccggctgctgaggtggctcagaccttcccacgtaggaaagagggagagggcaatgccatcaacgagtccaggaactgggttgagcgctttaccccaagaacagacacacactgtctgccactgtctagctgttggtataaaacccactctcaactctgaacatcagtttcccagtctgtcaaatgggagtgtgagctacctgccaaaatgcagggaggcttctggggaagctcggggttatgaatgacctctcctggtgtttgttaaagaatcaaggctgggcatggtggcccacgcctgtaatcccagcactgggaggccaaggcaggaagatggcttgagcccaggagtttgagaccagcctgggcaacatggcaagacctcatctctactaaaaattgaaaaattagccgggcacagtagcgtgcacccatagtcccagctgcttgagaggctgaggcaggagggccacttgagcccgggaggttgaggctgcagtgagccatgatcacaccactgcactccagcctgggtgacagagtaaaaccctgactctaaaagaaaaaaaaaaaaaaaagggatcaagcacatatgtctccacataggcgggcatcctgacccccgtgctcctgactgagacttcgctggcctcccccacactcactgcgtcctctgcacccctgctgtcctcccctctggatgggattccctggtgtgggtggggtccaggatgggggctgcagggtgtgcaggagaatgaggggcttgtgctgacctcactgccaagcccctgcccccatcctggtcccagccttggagcagaggctcagggccaccttccaccccacatttctcttccccctcccccagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctggtgagtgtcctcccggcggggcccagggagaggcagccaaagagccaggtccctgtgccccatgccgggcctacgccccaacttctgtggctcgtgtgcttacacgtctttgaaacatctcccctgtactctccacccccaaggccaaggggtggcctccatacacatcctctggagtctgtgcactgcgagcccaaacccgttacttagctgtgtagctctgggcaagttacagagctcctccatgcctcagtttcctcagctgcaaagtgggattaatacctattttataagatggccgtgaggatacattgagatgacgggacacacttagtgtggtgcctgtcttgtaaggcacacgatgaagggttgttatcggcactacgcttcctgttacggatgttctccatctgatcatggttggtttgcatctgtatttctatcccaagagaaggtcactctcctgaagtttcatttctggtttttcctggtggctggagaccgaggagccttcccctgagtcttgagatggcctgaggttgggtttgtggtaggggctggaggctgacctggggcttctcctgttagcctcaagcctcacccaccttggtgctctaaccagcactggagtcctgctgcccagagggtttgcagccccccagccgggcccaatagccccaccctgtgcctttcagtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtaca

SEQ ID NO: 80513 - DNA, 4654 bp, Homo sapiens
agcggcttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaaggtgaggcctcaggggcagggtccccccatcttggcagccacctgtccagaagcccagtgtggggacccactctcaccaccagggatccggctgctgaggtggctcagaccttcccacgtaggaaagagggagagggcaatgccatcaacgagtccaggaactgggttgagcgctttaccccaagaacagacacacactgtctgccactgtctagctgttggtataaaacccactctcaactctgaacatcagtttcccagtctgtcaaatgggagtgtgagctacctgccaaaatgcagggaggcttctggggaagctcggggttatgaatgacctctcctggtgtttgttaaagaatcaaggctgggcatggtggcccacgcctgtaatcccagcactgggaggccaaggcaggaagatggcttgagcccaggagtttgagaccagcctgggcaacatggcaagacctcatctctactaaaaattgaaaagcaggagggccacttgagcccgggaggttgaggctgcagtgagccatgatcacaccactgcactccagcctgggtgacagagtaaaaccctgactctaaaagaaaaaaaaaaaaaaaagggatcaagcacatatgtctccacataggcgggcatcctgacccccgtgctcctgactgagacttcgctggcctcccccacactcactgcgtcctctgcacccctgctgtcctcccctctggatgggattccctggtgtgggtggggtccaggatgggggctgcagggtgtgcaggagaatgaggggcttgtgctgacctcactgccaagcccctgcccccatcctggtcccagccttggagcagaggctcagggccaccttccaccccacatttctcttccccctcccccagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctggtgagtgtcctcccggcggggcccagggagaggcagccaaagagccaggtccctgtgccccatgccgggcctacgccccaacttctgtggctcgtgtgcttacacgtctttgaaacatctcccctgtactctccacccccaaggccaaggggtggcctccatacacatcctctggagtctgtgcactgcgagcccaaacccgttacttagctgtgtagctctgggcaagttacagagctcctccatgcctcagtttcctcagctgcaaagtgggattaatacctattttataagatggccgtgaggatacattgagatgacgggacacacttagtgtggtgcctgtcttgtaaggcacacgatgaagggttgttatcggcactacgcttcctgttacggatgttctccatctgatcatggttggtttgcatctgtatttctatcccaagagaaggtcactctcctgaagtttcatttctggtttttcctggtggctggagaccgaggagccttcccctgagtcttgagatggcctgaggttgggtttgtggtaggggctggaggctgacctggggcttctcctgttagcctcaagcctcacccaccttggtgctctaaccagcactggagtcctgctgcccagagggtttgcagccccccagccgggcccaatagccccaccctgtgcctttcagtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtaca

SEQ ID NO: 80514 - DNA, 3186 bp, Homo sapiens
agcggcttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtacaaaaaggagcgagcagtctcgtacagaaaagctgactttgatagattgatgccaaagatggagaactgaagtcccccctccaggcctaatgagtgtgggtggggtgtgcttgtgtgtatgtgtgtggtgt

SEQ ID NO: 80515 - DNA, 3028 bp, Homo sapiens
agcggcttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtaca

SEQ ID NO: 80516 - DNA, 4291 bp, Homo sapiens
agcggcttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaaggtgaggcctcaggggcagggtccccccatcttggcagccacctgtccagaagcccagtgtggggacccactctcaccaccagggatccggctgctgaggtggctcagaccttcccacgtaggaaagagggagagggcaatgccatcaacgagtccaggaactgggttgagcgctttaccccaagaacagacacacactgtctgccactgtctagctgttggtataaaacccactctcaactctgaacatcagtttcccagtctgtcaaatgggagtgtgagctacctgccaaaatgcagggaggcttctggggaagctcggggttatgaatgacctctcctggtgtttgttaaagaatcaaggctgggcatggtggcccacgcctgtaatcccagcactgggaggccaaggcaggaagatggcttgagcccaggagtttgagaccagcctgggcaacatggcaagacctcatctctactaaaaattgaaaaattagccgggcacagtagcgtgcacccatagtcccagctgcttgagaggctgaggcaggagggccacttgagcccgggaggttgaggctgcagtgagccatgatcacaccactgcactccagcctgggtgacagagtaaaaccctgactctaaaagaaaaaaaaaaaaaaaagggatcaagcacatatgtctccacataggcgggcatcctgacccccgtgctcctgactgagacttcgctggcctcccccacactcactgcgtcctctgcacccctgctgtcctcccctctggatgggattccctggtgtgggtggggtccaggatgggggctgcagggtgtgcaggagaatgaggggcttgtgctgacctcactgccaagcccctgcccccatcctggtcccagccttggagcagaggctcagggccaccttccaccccacatttctcttccccctcccccagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacagtgagtactgggggtccgggagcagggccacccagaaccaaggaaaggggttggtgagtgtgggcagaagaaccagaacaaagaggccagaggccccagccccagcagagcagccccgggcaccttgcctcccctgctggggttctcattccaaattgagggggcaaacagtgggaatgagacgctgcctcgagggctcagttggtccttctgggccagtccttactggaggccagctccacgcagccctctccagactatgcacttctctcccccagctgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtaca

SEQ ID NO: 80517 - DNA, 5077 bp, Homo sapiens
agcggcttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaaggtgaggcctcaggggcagggtccccccatcttggcagccacctgtccagaagcccagtgtggggacccactctcaccaccagggatccggctgctgaggtggctcagaccttcccacgtaggaaagagggagagggcaatgccatcaacgagtccaggaactgggttgagcgctttaccccaagaacagacacacactgtctgccactgtctagctgttggtataaaacccactctcaactctgaacatcagtttcccagtctgtcaaatgggagtgtgagctacctgccaaaatgcagggaggcttctggggaagctcggggttatgaatgacctctcctggtgtttgttaaagaatcaaggctgggcatggtggcccacgcctgtaatcccagcactgggaggccaaggcaggaagatggcttgagcccaggagtttgagaccagcctgggcaacatggcaagacctcatctctactaaaaattgaaaaattagccgggcacagtagcgtgcacccatagtcccagctgcttgagaggctgaggcaggagggccacttgagcccgggaggttgaggctgcagtgagccatgatcacaccactgcactccagcctgggtgacagagtaaaaccctgactctaaaagaaaaaaaaaaaaaaaagggatcaagcacatatgtctccacataggcgggcatcctgacccccgtgctcctgactgagacttcgctggcctcccccacactcactgcgtcctctgcacccctgctgtcctcccctctggatgggattccctggtgtgggtggggtccaggatgggggctgcagggtgtgcaggagaatgaggggcttgtgctgacctcactgccaagcccctgcccccatcctggtcccagccttggagcagaggctcagggccaccttccaccccacatttctcttccccctcccccagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggtagcccctgcgcccgccgcccctcctgctgcggccctggctctcccatccccaatcaggcacagcctgtgtccgcgccttctccttgcaggttggatacggatggcatccacctcctgagcagcctgctcctggtgagtgtcctcccggcggggcccagggagaggcagccaaagagccaggtccctgtgccccatgccgggcctacgccccaacttctgtggctcgtgtgcttacacgtctttgaaacatctcccctgtactctccacccccaaggccaaggggtggcctccatacacatcctctggagtctgtgcactgcgagcccaaacccgttacttagctgtgtagctctgggcaagttacagagctcctccatgcctcagtttcctcagctgcaaagtgggattaatacctattttataagatggccgtgaggatacattgagatgacgggacacacttagtgtggtgcctgtcttgtaaggcacacgatgaagggttgttatcggcactacgcttcctgttacggatgttctccatctgatcatggttggtttgcatctgtatttctatcccaagagaaggtcactctcctgaagtttcatttctggtttttcctggtggctggagaccgaggagccttcccctgagtcttgagatggcctgaggttgggtttgtggtaggggctggaggctgacctggggcttctcctgttagcctcaagcctcacccaccttggtgctctaaccagcactggagtcctgctgcccagagggtttgcagccccccagccgggcccaatagccccaccctgtgcctttcagtatgaatccaagagtcgcatgtcagcagaggctgccctgagtcactcctacttccggtctctgggagagcgtgtgcaccagcttgaagacagtgagtactgggggtccgggagcagggccacccagaaccaaggaaaggggttggtgagtgtgggcagaagaaccagaacaaagaggccagaggccccagccccagcagagcagccccgggcaccttgcctcccctgctggggttctcattccaaattgagggggcaaacagtgggaatgagacgctgcctcgagggctcagttggtccttctgggccagtccttactggaggccagctccacgcagccctctccagactatgcacttctctcccccagctgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtaca

SEQ ID NO: 80518 - DNA, 2463 bp, Homo sapiens
agcggcttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccccaccctccactcctccccacggtactgtgaacgtcgtgtgactcagtgcagagacagataatatatttaattcatgtacaaaaaggagcgagcagtctcgtacagaaaagctgactttgatagattgatgccaaagatggagaactgaagtcccccctccaggcctaatgagtgtgggtggggtgtgcttgtgtgtatgtgtgtggtgt

SEQ ID NO: 80519 - DNA, 2334 bp, Homo sapiens
agcggcttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccccaccctccactcctccccacggtactgtgaacgtcgtgtgactcagtgcagagacagataatatatttaattcatgtaca

SEQ ID NO: 80520 - DNA, 1955 bp, Homo sapiens
agcggcttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccgactcgccttagggatcctctagat

SEQ ID NO: 80521 - DNA, 1258 bp, Homo sapiens
ttaggtgaggctcgtgttaatcggacgaggccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtaca

SEQ ID NO: 80522 - DNA, 1158 bp, Homo sapiens
gatctagaggatccctaaggcgagccgggtactctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgccggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtaca

SEQ ID NO: 80523 - DNA, 1636 bp, Homo sapiens
agcggcttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaaggtgaggcctcaggggcagggtccccccatcttggcagccacctgtccagaagcccagtgtggggacccactctcaccaccagggatccggctgctgaggtggctcagaccttcccacgtaggaaagagggagagggcaatgccatcaacgagtccaggaactgggttgagcgctttaccccaagaacagacacacactgtctgccactgtctagctgttggtataaaacccactctcaactctgaacatcagtttcccagtctgtcaaatgggagtgtgagctacctgccaaaatgcagggaggcttctggggaagctcggggttatgaatgacctctcctggtgtttgttaaagaatcaaggctgggcatggtggcccacgcctgtaatcccagcactgggaggccaaggcaggaagatggcttgagcccaggagtttgagaccagcctgggcaacatggcaagacctcatctctactaaaaattgaaaaattagccgggcacagtagcgtgcacccatagtcccagctgcttgagaggctgaggcaggagggccacttgagcccgggaggttgaggctgcagtgagccatgatcacaccactgcactccagcctgggtgacagagtaaaaccctgactctaaaagaaaaaaccatttaactggcccggggtttcccgtcgg

SEQ ID NO: 80524 - DNA, 544 bp, Homo sapiens
gccgtggtcggcgagacccacaggaagtgtgtaacgacacctcctacggcacgcaccgagctcgcagtcgttgctgccccgaggaggtgtagatcgagcctcctgccgcacacacgttcgcacgcggcggccggcgcgctggaccgagaggttggagcaatccatcctccgcgcgcacgagctcagtccctactgccccgacaggtgtggaacccgccgtccccgctatggtccgaggaagtgtacagcactgctccctactacacgtcctgggcccgcggtccccgatgccccccggagctctgtgcacctccactgaaacgcaaggagcagacagaacctacaccatccgtgaggttttttccttcaccactttgaatgtcatcccactggcctgcaggatttctgaaaatttctgaaaactttgctggtagttacattagcacccctttgtatgtggtatgtttcttatctcttgctgctctcaaaattttctgtctttgatttttggtagtttgattattatgtgtcttgatatactcct

SEQ ID NO: 80525 - DNA, 960 bp, Homo sapiens
cggccgccccccacacaaaggggctccccgcctgggtcgcggcgtcggcgcgctcgtccccgccccgcgcgcgggctctcacccacctgcaggtgtctgtgcgtctgtccataggaacgcggtcggcgcgggggggcctgcgagagccgggcagcccgggctggacgggacgggccgaaggggcgcgagggcgggaggagagcggccagagggccgggcaccgaaggtgtggaacccgccgtccccgctatggtccgaggaagtgtacagcactgctccctactacacgtcctgggcccgcggtccccgatgccccccggagctctgtgcacctccactgaaacgcaaggagcagacagaacctacaccatccgtgaggcatccaaccatgatgaggtaccttgttgaacaaactaactctgccactgagaacgatgaaagctgtttaaaaaaataaataagtctgtttaaaacaattggagagcaaccctgtcatccaaggcttgagagtccacgagccccccaggaagaagagaaatactctgaatgtcagtacggggtctatcacatagtggaattaatgaggaaacagactcaaaaaggattttggcttgctcaaggtcacacagcttgtatgaggcagtgctgcaatttaaagccagcaagaaccatgaaacaggtcttataaaaagaaaaaaattacaattctggaggtgacctagttggaagcctgaaattccatgttgtgaaacaactagaggccggccctctgatcctttctctggatgtgctgaattcagcagggtggaagtgctaaaaccaggaggagcaatgaagtcagtgttgagaagaacatgcagctgagaagccaagtgggagaccgggacactgctctgattgaggataatgtatgttacactgtacccactccgttaagcacaataaatctcctttttcttg

SEQ ID NO: 80526 - DNA, 1194 bp, Homo sapiens
cggccgccccccacacaaaggggctccccgcctgggtcgcggcgtcggcgcgctcgtccccgccccgcgcgcgggctctcacccacctgcaggtgtctgtgcgtctgtccataggaacgcggtcggcgcgggggggcctgcgagagccgggcagcccgggctggacgggacgggccgaaggggcgcgagggcgggaggagagcggccagagggccgggcaccgaaggtgtggaacccgccgtccccgctatggtccgaggaagtgtacagcactgctccctactacacgtcctgggcccgcggtccccgatgccccccggagctctgtgcacctccactgaaacgcaaggagcagacagaacctacaccatccgtgagcactattcacaatagccaagaggttgaagcagcccaaatgttcatcaacagatgaagagatgaatgaaaatgtgatatatacatataatggaatattattcagccttaaaaaggaaggaaatcttatcacaggctacaacatagatgaaccttgaggatgttgtgccaagtgcaataaaccagtcacaaaaggacaaatactgttatgatttgacctatatgaactatgtagaggcatccaaccatgatgaggtaccttgttgaacaaactaactctgccactgagaacgatgaaagctgtttaaaaaaataaataagtctgtttaaaacaattggagagcaaccctgtcatccaaggcttgagagtccacgagccccccaggaagaagagaaatactctgaatgtcagtacggggtctatcacatagtggaattaatgaggaaacagactcaaaaaggattttggcttgctcaaggtcacacagcttgtatgaggcagtgctgcaatttaaagccagcaagaaccatgaaacaggtcttataaaaagaaaaaaattacaattctggaggtgacctagttggaagcctgaaattccatgttgtgaaacaactagaggccggccctctgatcctttctctggatgtgctgaattcagcagggtggaagtgctaaaaccaggaggagcaatgaagtcagtgttgagaagaacatgcagctgagaagccaagtgggagaccgggacactgctctgattgaggataatgtatgttacactgtacccactccgttaagcacaataaatctcctttttcttg

SEQ ID NO: 80527 - DNA, 389 bp, Homo sapiens
acgtgaccgcgctgcgggagagggatgaaacaagagggcggctgaagccgatcctgagtggggccccagcaattcggaatgagccttttccctccacccgcttctgccgaccggggccctcccgcgcggcctcgcaggcctccccacccgcgcccgtccctcctcctccgctttcccttctcccccgtcctcggctccgacattaggggcaggcggggcaggcagcccaagcagcctgcggcttccgctgcggagcgctgcgccccggcccctgccccggccccagcgccgccccgcccaagtccggacccaatcggaagagaggctcagactctgctggaaccagaagagacagcagggagcacggagaggccaagaaaaagacaaac

SEQ ID NO: 80528 - DNA, 343 bp, Homo sapiens
tttcttttttggttaggttcagtaaatggggatctatagcaggaggctgaagagtgacaatagtgaggtcagggcatttattttgctggtttcctcttgggtgtgttcctataagttaattatgccccttttacaaaaatcatagattttctaagtttttcctctatccctgcagccacactctctctgttctgatcattgtttcttcatttgcttctacagccttacagatcataatggctcttcactgttgctgtttctcaaccctctttagtttcttctaagccagtctgtacctttgtacatatttccttttttaaatcctctttaagtactgaaatgc

SEQ ID NO: 80529 - DNA, 811 bp, Homo sapiens
taacacctctgtgcttcagttttttttctcacttgtaaaattttgacaataattgtattcatggaattgttatgaggattaaatgaactaatataaaataaagcacttagaaccaaacctggaatataagtgctttgttaagtcagagcttaaaaaaaggaaattatcataaaagaatggtctgaagtacaaaatagaatggtgagtgaataaaatggtgaacaagcttgtcagtccaaacatcagtctagaaaaataaggtccgatttgtgaagttttgaactaatgcctccaataacaatagcaagtaggcatttgggggagggtcaatgtaattaaaattattctaagatcattacttcgtttcaaaggaaagttaagatatgtttgcctttacattttgttaagttagacacttataaaatgcagggacagttgttaaaaaaaaaagggaataaatacagagctatgaattccaattcagtggaggaaaaatggaatttaaaaaatctaaccataaagtcagttttttaaaaatgcagaaacagccagcgccgtggctcacgcctgtaatcccagcactttgggaggctgagacgggcagatcacgaggtcaggagatcgagaccatcctggctaacacggtgaaaccccgtctctactaaaaatacaaaaaattagccagacatggtggcgggcgcctgtagtcccagctacttgggaggctgaggcaggagaatggcatgaacccgggaggcagagcttgcagtgagccgagatcacgccactgcactccagcctgggcgacaga

SEQ ID NO: 80530 - DNA, 402 bp, Homo sapiens
aaaagtgcctgtctttatcatgtttaagatttttggcttgaatttattttatctggtatcaggattgctaccctgacttccttatttttccatttgcctgatatataccttttttcatccgtttttagctttttggatcacttttaggtctaggtctatctgttgtatatgatgtgcatgtatgtgtgtgtgtatatatagagcatatagttttatatatatacacacatatacatacacatacatatatagttagatcattctttgtgagcaaaattggaagtcttttagtagatgggtaaaaccctgttatgtttgggcttaactgtggcaaagtattatatattttgttattttctgatacttttctccatatgtgtattttttgttccttaatttttt

SEQ ID NO: 80531 - DNA, 610 bp, Homo sapiens
tttgaggctgcagtgagctatgaccataccactgcactccagcctgggccaacagagcaaggccttttttaaaaaaaatcaaaaaacagtgcaagatcaccctgacctccattctgcttcttaaaagcaaatgaaattcccaagtgaaagacgccctccccatatcaaataaaatgattttatcatcaaggacgacaggaagtcaaggccgacagaatttggtacagaccttgtgaaaacaactctttcaagcatccccacatcatgtagttgcttttttacaagtggctagtctttgtccaagtcagtatataagtgatttaatttggccactttgagtcttcatttcattataagggagcctgtgctgtataaaacttgtgttaaattaatatgcctggctggacacggtggctcacacctgtaatcccagcactttgggaggccgaggtggttggatcacttgagttgaggacctcaagcaatcctcctacacctcagcctcccaagttgctgggattacaggcatgaaccactgcacctgaccctgttagtttagcttatgtcagtttaattctcccgcccagcctggggccctaaaaggggagaa

SEQ ID NO: 80532 - DNA, 625 bp, Homo sapiens
gacccctgataggattgacggccagtcagaaatgggtgacaggagaggggagaatggagtaggggaagggtgatccttttgactggcacttcatcctggcttttccctcctacctcaggccttgaaggctgagcaggggatggtgaaaggggttggagctggtagggaagccccacagggtgtgggtctccactcagggatcaagagcagtgctgttgggaatcatgcatggtaaagacagcccttactcaagacagaaaaagcctgatgccacatgagaagggaagactgccagtttcatttagcattgttgcctagcggggatttcagggcgtcctgtcacgtgagaggaatggggaggcactagttgtggaaggcagagctggtaataatttagattttgtttcatagataacagcaatactaataacggtgtgatgacatttgaaggtgatactgatggccctacttgagtggttttctgatagtggtaatgtctgttgtgttgccctctttcataggtgtgaattaaatctggcaggaaaatttacatagttagaatagcaagacaaagggaatagatcatttcagaaggataagctgtacaatggtattttgaattaaa

SEQ ID NO: 80533 - DNA, 337 bp, Homo sapiens
cactacaaacagcatagaaagcaagagaagttgggaatttattctaaaatagaatggaggttgtcatctacagcagcactcctcactcctctgttgccatttttagcaaggttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80534 - DNA, 871 bp, Homo sapiens
cagaaccagggggcaagaccttcattgtgggagaccagatctccttcgctgactacaacctgctggacttgctgccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80535 - DNA, 296 bp, Homo sapiens
catgcaacaacgccactggtaataaagctttggaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80536 - DNA, 518 bp, Homo sapiens
  misc_feature (112)..(112): n is a, c, g, or t
taatgtcgctacaagcattgtttcctggcaaatgtgcaagtggtggggtcgctgccgctgctgctccgccgctctgctgcctcttctctcaagggtggttcttcgtccttcntgagcccctcaagcttcgcctctgctcgtgccgaattcggcacgagtcaagatcgacaaggagtacttgctaaaaaagcattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80537 - DNA, 130 bp, Homo sapiens
atatcgtcgacccacgcgtccgatttgaaaaaaacttcattctcgtgagtcatttaaatgtgtacaatgtacacactggtacttagagtttctgtttgattcttttttaataaactactctttgatttaa

SEQ ID NO: 80538 - DNA, 365 bp, Homo sapiens
gcagccgctactactactaaattcgccccccgatcggcattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80539 - DNA, 431 bp, Homo sapiens
  misc_feature (326)..(326): n is a, c, g, or t
  misc_feature (343)..(343): n is a, c, g, or t
  misc_feature (349)..(349): n is a, c, g, or t
  misc_feature (388)..(388): n is a, c, g, or t
  misc_feature (397)..(397): n is a, c, g, or t
taaattcgccaccattaactgaaaaagatctgctagaagatggttttggagagcaccccttttaccactgcctggttgcagaagtgccgaaagagcactggactccggaaggttacagtctctagcttcgccatgtacatggcccttccgtgtacatggatgggcggggaggtaactaaaagatcctttacacaataaagtagatgatcatgataaatgaggacacagcattgttggttttgccatgtactattttacctatgacccgtggattggcaagttattgtatcttgaggacttcttcgtgatgagtgattatagagttnggcataggatcaagaanttcctnaaggaatcttacgccaggtttgcaatgaagtgtcgcctncaggcaagnattcaacttccttcgggttggcagaatctggatt

SEQ ID NO: 80540 - DNA, 2987 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80541 - DNA, 2933 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80542 - DNA, 2933 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80543 - DNA, 2062 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80544 - DNA, 1542 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80545 - DNA, 3077 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggtacgattgagttcggagcagagggtctgaagagagttcagagttataaatgcttacaatgactttttaaattgtactctttctttttaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80546 - DNA, 3202 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggtacgattgagttcggagcagagggtctgaagagagttcagagttataaatgcttacaatgactttttaaattgtactctttctttttaggctttggcataggatcagaaattctgaagaatctaagccaggtatgtcttagtttttggtttccaaatttgtaagtttactggattattttaatgatggaataaaaattgggtcttgagagcaggctgaaatgtcactgagtgtgtgttttactctctcataataggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80547 - DNA, 2884 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagacacagcattgttggttttgccatgtactattttacctatgacccgtggattggcaagttattgtatcttgaggacttcttcgtgatgagtgattatagaggctttggcataggatcagaaattctgaagaatctaagccaggtatgtcttagtttttggtttccaaatttgtaagtttactggattattttaatgatggaataaaaattgggtcttgagagcaggctgaaatgtcactgagtgtgtgttttactctctcataataggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80548 - DNA, 3019 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaaagccagacgccagccacaccacaacgaacaca

SEQ ID NO: 80549 - DNA, 3016 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaaaaaaaaaaaagaaaaaaaaaaaaaaaaaa

SEQ ID NO: 80550 - DNA, 3011 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaaaattgtttggtgtaagcattttta

SEQ ID NO: 80551 - DNA, 3043 bp, Homo sapiens
  misc_feature (3024)..(3025): n is a, c, g, or t
  misc_feature (3027)..(3028): n is a, c, g, or t
  misc_feature (3030)..(3030): n is a, c, g, or t
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaaaaaaagtcgacgcggccgcgaatttagtagtagtagnngnngnagtaggcggccgc

SEQ ID NO: 80552 - DNA, 3014 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaagacttcaacacaaataacaccacacac

SEQ ID NO: 80553 - DNA, 3072 bp, Homo sapiens
  misc_feature (3042)..(3043): n is a, c, g, or t
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaacaaaaaaaaaaaacaaaaaaacaaaaaaaaaaaaaaaaaacaaaaaacaaaaaannaaaaaaaaaagaaaaaaaaaaaaaaaaaa

SEQ ID NO: 80554 - DNA, 3162 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaaaaaaaaaagaaaaaaacatagataacatacacaaatgcaaaaatactaatagaaaactcgcggatgatgaactacatgatctacgatacctgtgtaatactagttcctgaataggcgcaactgcctaaacagtattatgaactggctatatcagggatctttttatgatgcactg

SEQ ID NO: 80555 - DNA, 2094 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaaagccagacgccagccacaccacaacgaacaca

SEQ ID NO: 80556 - DNA, 2848 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggccctcatcccagtgacgttcctcatcccagtgacgttcctcatcccagtgacgttcctcatcccagtgacgttcctcatcctacacttc

SEQ ID NO: 80557 - DNA, 2938 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80558 - DNA, 1598 bp, Homo sapiens
  misc_feature (1579)..(1580): n is a, c, g, or t
  misc_feature (1582)..(1583): n is a, c, g, or t
  misc_feature (1585)..(1585): n is a, c, g, or t
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaaaaaaagtcgacgcggccgcgaatttagtagtagtagnngnngnagtaggcggccgc

SEQ ID NO: 80559 - DNA, 3229 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggtacgattgagttcggagcagagggtctgaagagagttcagagttataaatgcttacaatgactttttaaattgtactctttctttttaggctttggcataggatcagaaattctgaagaatctaagccaggtatgtcttagtttttggtttccaaatttgtaagtttactggattattttaatgatggaataaaaattgggtcttgagagcaggctgaaatgtcactgagtgtgtgttttactctctcataataggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaagacttcaacacaaataacaccacacac

SEQ ID NO: 80560 - DNA, 2743 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacagacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctcgaggacatccaaggctccgaaatatactttaaagatgaaagggatttcgaaacgttagtcaggtcattaggaggaggaggagag

SEQ ID NO: 80561 - DNA, 2013 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80562 - DNA, 1340 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggccctcatccacaggatccgctagagt

SEQ ID NO: 80563 - DNA, 2094 bp, Homo sapiens
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagtctgctggagctcacactcaggaagcgagaacgctttcattacctgccagagcaaaactgctatggttttaaactcaacacacacattatggtccggc

SEQ ID NO: 80564 - DNA, 1082 bp, Homo sapiens
  misc_feature (1063)..(1064): n is a, c, g, or t
  misc_feature (1066)..(1067): n is a, c, g, or t
  misc_feature (1069)..(1069): n is a, c, g, or t
cgtgggttccttgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaagggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaagtcgacgcggccgcgaatttagtagtagtagnngnngnagtaggcggccgc

SEQ ID NO: 80565 - DNA, 1072 bp, Homo sapiens
  misc_feature (1)..(2): n is a, c, g, or t
  misc_feature (5)..(8): n is a, c, g, or t
  misc_feature (17)..(18): n is a, c, g, or t
  misc_feature (20)..(23): n is a, c, g, or t
nngannnnggccaatgnncnnnngcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaa

SEQ ID NO: 80566 - DNA, 2018 bp, Homo sapiens
  misc_feature (1968)..(1968): n is a, c, g, or t
  misc_feature (1970)..(1970): n is a, c, g, or t
  misc_feature (1972)..(1973): n is a, c, g, or t
  misc_feature (1982)..(1982): n is a, c, g, or t
  misc_feature (1985)..(1985): n is a, c, g, or t
tgaaacagcagattacttttatttatgcatttaatggattgaagaaaagaacctttttttttctctctctctctgcaactgcagtaagggaggggagttggatatacctcgcctaatatctcctgggttgacaccatcattattgtttattcttgtgctccaaaagccgagtcctctgatggctcccttaggtgaagttgggaactatttcggtgtgcaggatgcggtaccgtttgggaatgtgcccgtgttgccggtggacagcccggttttgttaagtgaccacctgggtcagtccgaagcaggggggctccccaggggacccgcagtcacggacttggatcatttaaaggggattctcaggcggaggcagctatactgcaggactggatttcacttagaaatcttccccaatggtactatccagggaaccaggaaagaccacagccgatttggcattctggaatttatcagtatagcagtgggcctggtcagcattcgaggcgtggacagtggactctacctcgggatgaatgagaagggggagctgtatggatcagaaaaactaacccaagagtgtgtattcagagaacagttcgaagaaaactggtataatacgtactcgtcaaacctatataagcacgtggacactggaaggcgatactatgttgcattaaataaagatgggaccccgagagaagggactaggactaaacggcaccagaaattcacacattttttacctagaccagtggaccccgacaaagtacctgaactgtataaggatattctaagccaaagttgacaaagacaatttcttcacttgagcccttaaaaaagtaaccactataaaggtttcacgcggtgggttcttattgattcgctgtgtcatcacatcagctccactgttgccaaactttgtcgcatgcataatgtatgatggaggcttggatgggaatatgctgattttgttctgcacttaaaggcttctcctcctggagggctgcctagggccacttgcttgatttatcatgagagaagaggagagagagagagactgagcgctaggagtgtgtgtatgtgtgtgtgtgtgtgtgtgtgtgtgtgtgtatgtgtgtagcgggagatgtgggcggagcgagagcaaaaggactgcggcctgatgcatgctggaaaaagacacgcttttcatttctgatcagttgtacttcatcctatatcagcacagctgccatacttcgacttatcaggattctggctggtggcctgcgcgagggtgcagtcttacttaaaagactttcagttaattctcactggtatcatcgcagtgaacttaaagcaaagacctcttagtaaaaaataaaaaaaaataaaaaataaaaataaaaaaagttaaatttatttatagaaattccaaaggcaacattttatttattttatatatttatttattatatagagtttatttttaatgaaacatgtacaggccagataggcattttggaagctttaggctctgtaagcattaaatggcaaagtccgctatgaacctgtggtaaattcatgcaagtagatataatggtgcatggatataagaaattctaatgaccctaatgtactaaaggcgacaatctcttttgtgcccatattattgtaaacttatgcacatcgctcatgacactgagtattcactcttcagactgcttgtttcatagcttatcccagaggattaaagataaactgggtctcaaactttgattctgtgtctgcaatatttcctctctcataagtgactccactattgtaacttcatggttggaaaatatgagggttgatatatgtcttacttgtttaaatctgtcgcagaatataccaaagctaaataataactatgctttcattttagccgatctccagaatgacagtattaacatcaaacattgtattgatttagaattctcaaaaaanananntcgacgcgnccncgaatttagtagtagtacgcggcccctctcgag

SEQ ID NO: 80567 - DNA, 2126 bp, Homo sapiens
  misc_feature (2076)..(2076): n is a, c, g, or t
  misc_feature (2078)..(2078): n is a, c, g, or t
  misc_feature (2080)..(2081): n is a, c, g, or t
  misc_feature (2090)..(2090): n is a, c, g, or t
  misc_feature (2093)..(2093): n is a, c, g, or t
tgaaacagcagattacttttatttatgcatttaatggattgaagaaaagaacctttttttttctctctctctctgcaactgcagtaagggaggggagttggatatacctcgcctaatatctcctgggttgacaccatcattattgtttattcttgtgctccaaaagccgagtcctctgatggctcccttaggtgaagttgggaactatttcggtgtgcaggatgcggtaccgtttgggaatgtgcccgtgttgccggtggacagcccggttttgttaagtgaccacctgggtcagtccgaagcaggggggctccccaggggacccgcagtcacggacttggatcatttaaaggggattctcaggcggaggcagctatactgcaggactggatttcacttagaaatcttccccaatggtactatccagggaaccaggaaagaccacagccgatttggcattctggaatttatcagtatagcagtgggcctggtcagcattcgaggcgtggacagtggactctacctcgggatgaatgagaagggggagctgtatggatcagtaagtactggagggacttcatccagctttatctccatgtttgatttgaacagctgtcttttctctggattaaaaagggccagaaatgcaactgagtctgtttggaaggaaaaactaacccaagagtgtgtattcagagaacagttcgaagaaaactggtataatacgtactcgtcaaacctatataagcacgtggacactggaaggcgatactatgttgcattaaataaagatgggaccccgagagaagggactaggactaaacggcaccagaaattcacacattttttacctagaccagtggaccccgacaaagtacctgaactgtataaggatattctaagccaaagttgacaaagacaatttcttcacttgagcccttaaaaaagtaaccactataaaggtttcacgcggtgggttcttattgattcgctgtgtcatcacatcagctccactgttgccaaactttgtcgcatgcataatgtatgatggaggcttggatgggaatatgctgattttgttctgcacttaaaggcttctcctcctggagggctgcctagggccacttgcttgatttatcatgagagaagaggagagagagagagactgagcgctaggagtgtgtgtatgtgtgtgtgtgtgtgtgtgtgtgtgtgtgtatgtgtgtagcgggagatgtgggcggagcgagagcaaaaggactgcggcctgatgcatgctggaaaaagacacgcttttcatttctgatcagttgtacttcatcctatatcagcacagctgccatacttcgacttatcaggattctggctggtggcctgcgcgagggtgcagtcttacttaaaagactttcagttaattctcactggtatcatcgcagtgaacttaaagcaaagacctcttagtaaaaaataaaaaaaaataaaaaataaaaataaaaaaagttaaatttatttatagaaattccaaaggcaacattttatttattttatatatttatttattatatagagtttatttttaatgaaacatgtacaggccagataggcattttggaagctttaggctctgtaagcattaaatggcaaagtccgctatgaacctgtggtaaattcatgcaagtagatataatggtgcatggatataagaaattctaatgaccctaatgtactaaaggcgacaatctcttttgtgcccatattattgtaaacttatgcacatcgctcatgacactgagtattcactcttcagactgcttgtttcatagcttatcccagaggattaaagataaactgggtctcaaactttgattctgtgtctgcaatatttcctctctcataagtgactccactattgtaacttcatggttggaaaatatgagggttgatatatgtcttacttgtttaaatctgtcgcagaatataccaaagctaaataataactatgctttcattttagccgatctccagaatgacagtattaacatcaaacattgtattgatttagaattctcaaaaaanananntcgacgcgnccncgaatttagtagtagtacgcggcccctctcgag

SEQ ID NO: 80568 - DNA, 576 bp, Homo sapiens
atgggcatcagcagcagtgcccatcatagagtatactttgccacgacacaagctctgaggagagacaagcccccaccacaagaaacagcaactgtgtccaggagtatgtaaggttgggaaatagagacaagtgaagcagccaacttggacccgcaagtgggaccaagtatggagcatggcagggcttgcttccaggatccctgaatgacactgtggggcaaagctaccgaccctccatggactgccagctacctctgaacagtgatgcagaaaaaaaaaaatgcatcttagaatttccatatggattgcagccttgacatggaaaagtgaaaatcaatttggatgcacagcaggcccagagcataagaagtgacatggagaactctatcctgggggaagggtgagagaaaggagagtctgcatgtaatgagaccagaaatcaaagggggaatgaatgagctgaaacctctgtgcacaagaagcccagcagagtagctaaagatggaggaatctgtagtcacctttgactcccaggccacactgggcttccataatgccacaactccaggggaaagg

SEQ ID NO: 80569 - DNA, 647 bp, Homo sapiens
aatttttgtatttttagtagaggtggggtttcaccatgttggccaggctggtctcagactcctgacctcaaatgatttacccacctcggtgtcccaaagagctgggattacaggcatgagccagcacgctcagccttttaagtattttttaggattcaccagtgaagccacctgtacctgtacttttctctgttaggaagtttttgatgaattcagtctcttgttacagaaatttgaaatttttctatttcttcatgggtatgaatcagttttaggtaattagtgtctttctaggaatttgtccattacatcaagttaattttgtttgttcacatacagttgttcctaataatctgtctctctctctgtctcatttttcctgagatggaatgaatcattctttatggcagctctagccccaggttgttttacctgtgtttctgactgactggctataaactggtgttcccacaactccctccttggatttgattactttgtcagagtggcttaccaaactcaaggaaatacttacttatatttactggtttatgacaaagaaaggatgttataaagaatcacagtgaaagagatacatagggcaaggtataggggaagggactagagcttccaggccctccgcgggt

SEQ ID NO: 80570 - DNA, 349 bp, Homo sapiens
atttgtttgcaattgacaacacctcattaattgtaagcccagtgacactgcttgctgtttcaagtcacttttaaattacacacgtgctacttaatcttaaaagcaaaattaaacattggactggtttacatttcaagctacaatatggaaccattgtatttggaggaatgagtttaatatgcattgtaaaataaaattagggggtactttgcattcacagcggcttatgtaattaggttcagtcaactgtaatgtttcaggttaatgtcttccatgatgtatgctgtgtaaatagtgaacttacatatcccttaatacatctgaattattacataaatccttaatatta

SEQ ID NO: 80571 - DNA, 311 bp, Homo sapiens
ttttgtatttttagtagagacgggggtttcaccatgttagccaggatggtctcgatctcctgacctcgtgatccgcccgcctcggcctcccaaagcgctgggattacaggcgtgagccaccgcgcctggccgcaaatattttttaaatacagtttatcaagaagaaatagaaaatatgaagagtcttaaaatgattgaggagattgaatcagttgttgaaaagtcttcctcaaagaaaacactagtcccagttggcttcaccagcagtttcaccaaacatacagaaaaaaaagaatttcaatcttactaca

SEQ ID NO: 80572 - DNA, 596 bp, Homo sapiens
gtctgagcagcagcaaaataaataaataaataaataaataaataaaataaaactttttaaaggtcaccgaggctgctgtgtggccaggggagctatagaggagcaagggtagaggagggcaagcctgggaggaggcctttgtgaggatggaggcatagactggggttttgacagtggggatggagagatgaggacagatctgaaatatgttttgaagaacatatttaacagaacttgctcatggattggaagagattttaggggagagagagggaggtagatgttccccacttggtgcaccctgatggttgcagactgaattccaatagaatcttctccccaaggtctttttattccctctctcttttcctcaattcagccactctatgagtagttaatacaggtatttatttcacagatgaggtgagactcagggagatgaaatgactcatttagagttatcaggtgcagacagaaattttactctacccagaaaaccaaaatataggcatgaaatcagtgttcttcaaactgaattgtctctcattaattgattgtgaaatcaacataatgagttcctatcagcattaaagaaa

SEQ ID NO: 80573 - DNA, 461 bp, Homo sapiens
tgttttctagaaaggggatccttccaatccctggtttcccaggatgaggctttcggctttagctattagactggaatcatggagagcttgttaaaacagtgtgggcctcgcccccagagtttgacccagtaggtctgcggagggggcctgagaatttgccttgggtttccatgtgatcctgctgctgctggtcttcggcccacactttgcagactcctattcctaggactgtcctcaatttcgggcagctggggaggaaaataccactatcttattctcactttgagcctttctcacccctatagcaccctttatggaaactgtgcagggccagagtttttggctgggtgtggtggctcactcctgtagtcccagcactttaggaggctgaggcgggaagatcacttgaggccaggagtttaagaccagcctgggcaacatagtgagaccgtgtctctact

SEQ ID NO: 80574 - DNA, 757 bp, Homo sapiens
gcagaacaggcaggtgagagtctaagagggctcagtaatctgaagcttggtgggaagaagggattctgggctagaaagggtgcagaagcctgaagtagaaagagacgggattttggtccggggtggagagcgaatgcattgaaaagggccaaggcccaggataaggtagacatttaaaggggtacggatgcccaaggtagagcagacacttgaggagaccagctcagcaaacggaagacacttaaagtggtaggttctcaagagagaagaagtttttaagactagagctaagcaagacatttaaaaggacatgggttgggatttgggaacacgtttattccagaggcaggaacaaaggagtcgcttgtcaaggatctggttagagaagactagggtcttcctcgaaggaagcacgcgcacgcctgctctcccccattgtcttttctggcttctccaggttccctcgacccaggaccccctgttcccaggctatggcccccagtgccctgtagacctggcaggccccccgtgcttgcgacccctatttgggggtctgggtggctactggagggccttgcagaggggcagagaaggcaggaccatgacatctagggcctctgaactttctccggggcgcagcgtgacggctggcatcatcattgttggagatgagatccttaagggacacactcaggacaccaacaccttctttctgtgccggacactgcgctccctaggggtccaggtttgccgagtc

SEQ ID NO: 80575 - DNA, 799 bp, Homo sapiens
gcagggaccagcccgcagatgagcttccagtgagggcagccagtgggactgagggcaggcagccagcctaggtgtgctgggcagcacaggggcttccatccttcatcccgtgtgcccatcgtagccaccgtgtaaggctggaactggcatccccattttacatgttgaagccaagcctcagaggagcttcagtatcattgaggcctcaaagttgacaggtggtacagctgatttcctgactccagaactccagacactccccgctggtggtcatgtcagtgctttttttttcttcttcttttgagacagggtctcactctgtcacccagtctggagtacagtggtgtgatcttggctcactgcagcctctgcctctcaggctcaggtggtgatcctcctgcctcagtctcctgagcagctgggactgcaggctacaggcgcctgccaccaggcccagctaatttttgtatttttagtagagacagggttttgccatgttgcccaggctggtcttgaactcctgggctcaagtgagctgcctgcctcagcctcccaaagtgctgggattacaggcgtgagctactgcgcccagccaattctagtgctttaagcggggcagaagacagagttaaaactgctgctaatgcccggctcccactggctctgagcttttatgaatactgcccaaagttaaacttggagttccctgcattgttgggcagccagagccctagccagtgctgagacttagaattgctgactgcggtgaggtcatctccatgaccccagactcaggaca

SEQ ID NO: 80576 - DNA, 398 bp, Homo sapiens
agtcggtcatttggaaaccattcttctaaaggatggtgtagagagcactgaagtttacattgtggtatatagcctttgttgcagtaagtgatggtaacccatttgagcagctgtatgatctgaatagtctggaggggggtatgattacttacggctacattagtcaccataaataatccagttgccctgcagagtaacactcttggctgagcataatgtataactttaatctggacccagtataattccatagtacagaagctggtttgttcttctcagtctatttgatattactttgtttcattcttcttgggggttttttttgggggcctttaccccccccccccaaaagggggattgttcatttagaacactgtgcctgatgtggtggctcatgc

SEQ ID NO: 80577 - DNA, 175 bp, Homo sapiens
ggaacgtgtgtgagggcacggcctttgccagccaggtgtcctgctgagcagccgcgtctgaatggggccggcctcgcgggccgaagcactcctgtcctccacccgccttcacccctcacccgcacccagctcctcccggctcgtggccacatgaagacctcagacaaatggggca

SEQ ID NO: 80578 - DNA, 822 bp, Homo sapiens
ctggggggtggcaccaggctgtgaaggatccacagactggcatatgcaggaggaaatggggcgggcgaggagtaaggaccccaaaaagcaggggtagggaagggccctcccagcgccccactgtaataggggcctcatcaatgccccatgctcactgaataaagcactgccagcgaaaggtgaaaagaggaacaaagaacattctcctggacgccacccacagaaagccacgtgcaggcttggccctcaccttggggaccttggacacggagctggttatgtcacatctggctctcagagctggggcagcgtctaggaggcctgatgtagaaagcactcagctaagccctagttaccggcacacgggcaccagcgccccctctcagcaaactccacgtcttatgaaattagcactggatttccacttcaattggaaaatatggccaagatccatccacgtgtggctgactcagagctgtgacattaagggaacaataacaggaaatgattgagctgccttttcagacaacactggaatttttgaagaacccgagaatcagtatattgaaaggtctgcgccgtggagtccctgcttgtgaagcccgtgtgcatccgaagtgctgacaaggacaatggaaagacgcttcattcatgagctcctttaaaatgccagacgggcccctcgacagggacggggagaacttcagcagactgaatacgattggcaacataaacccaaacgtttggggaaacaaaactgattttattatttctattttactttatcctattttttgagacaggctatcgctctgtcaccca

SEQ ID NO: 80579 - DNA, 724 bp, Homo sapiens
ctggggggtggcaccaggctgtgaaggatccacagactggcatatgcaggaggaaatggggcgggcgaggagtaaggaccccaaaaagcaggggtagggaagggccctcccagcgccccactgtaataggggcctcatcaatgccccatgctcactgaataaagcactgccagcgaaaggtgaaaagaggaacaaagaacattctcctggacgccacccacagaaagccacgtgcaggcttggccctcaccttggggaccttggacacggagctggttatgtcacatctggctctcagagctggggcagcgtctaggaggcctgatgtagaaagcactcagctaagccctagttaccggcacacgggcaccagcgccccctctcagcaaactccacgtcttatgaaattagcactggatttccacttcaattggaaaatatggccaaggtggagaaccccttctttaagcaaaagatggcacggacccccgacataagacagttcaaagctgagcggctctccccatcatgcaagtaacctgcgtgccgccacgggaaacagcacgcatcccatctggactcccaccagacaactgaggcaaccgagaaggaggctggggagggacagctcgagggctcactggaggtcagcagggaggtggactgcgtctcccgagggccagcactggcttagcctgctcagtgaggtgcccgaaggaggccc

SEQ ID NO: 80580 - DNA, 427 bp, Homo sapiens
aactcctggactcaagcgatccgcccacctcggcctcccaaagtgctaggattacaggcgtgagccaccacaccggccttctatttttcttaccagcatgaattaaatcctttttgtctttttcttttttttgagacagagtcttgctctgttgcccaggctagagtgcagtggcaccatcttggctcactgcaacatcggactcccaggttcaaacgattctcctgcctcagtctcccgagtaggtgggactacaggcatgtgccacaacacctggctaatttttgtatttttagtagagacggggtttcaccatgttggtcaggctggtcttgaactcctgaccttgtgatctgcccgcctcggcctcccaaagtgctgagattacaggtgtgagccaccgcacccggccaatccttgcttcctt

SEQ ID NO: 80581 - DNA, 553 bp, Homo sapiens
aaaaaccattgaattgtacactttaaactggtgaattgtatggtatgtgaattatatctcaataaagttgttaaaataattcaatactaagaaaaccaaccaataaaaaatggactaaatatttgaacagacaattcaccaaataagatatctggatggcaaataaacacatataaagatgctttcctcattagccattaaggagataaaaattaaaaccacagtgagataccactacagatctattcgaatggctaaagttaaaaagactgactgaagtactattccaattatgtgaggtagtagagtagttacagtcatagagacagaaagtagaatggtggttgccaggggctggggaaggcgcaaatggaaagttaatgtttaatgggtacagtgtttcagtttggaaaggtgaaaaaggtgtggagatggatggtggtaatggttgcagagcaatgtgaatatacttaatgctgacaaaatataaacttaacaacagttaaaatttgttatgtgtaattacctacaattaaaaaatatgtaaatgaag

SEQ ID NO: 80582 - DNA, 656 bp, Homo sapiens
tccgaccgatctgtcttttggttttaacccatgttcccccgtgctgcctaagaagctgagtttcggcatgagttgaatttctgtctttagtttctaaaggatttacactaactagagcatcgctagataactcagggtgatgcgagaggctcacacccatgagagaaattgctgcaggatctcaggatgtttagcagggagaagactgtgtggggacagcagagctatctccaaaacatttgtagggtaatatcatgtgcaaaagaaattagatttattccgcatgactccataagtggagacatattttggttttatagatagaagacatttatgaaaaataagattgttacccaggcacggtggctcccacctgtaatcccagcactttgggagactgaggcaggagaatcactggaagccaggagttcaaaactacctgggcaacatagcaagaacccatctctgcaaaaaatttaaaaaattagccaggtatggtggcacatgcctgtagtcccagctactcataggctgaggtgggaggatccacttgagcccaggagttagagactgcagtgagctgtgatggtactactgcactccagcctgggcgagagagtggatccttgtctctccaaacaggatgaatcggcgga

SEQ ID NO: 80583 - DNA, 1136 bp, Homo sapiens
cggggagcggtgccggaagtagtcggggagggccgcgcagtcggaccggctgctgagacgaacgcttcactggggcagtctctgcatatcatggggagatagacgctgctgcctttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctaccccaacttccggtcccttttccctgccatctcaaagaggagcaatgtatcttccagagaagattttatttgtggtttattatataagtgactgaatatgggacaaagcattatggtctttttgggtaagacagtattagcaggatttgtaaagggttttgtttccttctcccttccccttttccctgtactttgtaatgtcagtgtttatatgaatatgactttcatttgcttttccagaataaagaagttattaatcgaaaaaaaaaata

SEQ ID NO: 80584 - DNA, 869 bp, Homo sapiens
cggggagcggtgccggaagtagtcggggagggccgcgcagtcggaccggctgctgagacgaacgcttcactggggcagtctctgcatatcatggggagatagacgctgctgcctttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctacccca

SEQ ID NO: 80585 - DNA, 865 bp, Homo sapiens
cggggagcggtgccggaagtagtcggggagggccgcgcagtcggaccggctgctgagacgaacgcttcactggggcagtctctgcatatcatggggagatagacgctgctgcctttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaaggaattccggaattccggaattccggcatatgaagtgctgtcggatgctaagaaacag

SEQ ID NO: 80586 - DNA, 1206 bp, Homo sapiens
cggggagcggtgccggaagtagtcggggagggccgcgcagtcggaccggctgctgagacgaacgcttcactggggcagtctctgcatatcatggggagatagacgctgctgcctgtgagtcttgggccctggcagttgaggaacaagagcgggaggagggagtcaggacccagacctacagtgggtcagtgttcgaaggaccaggttgtggacgagacggggctgtgaggattcaggctcttgggaagggactgactgagaggatcaggctcggagaagacgcggctgtggggacccgggctccaagacgggacttagggaacggggacggatgcgagttctccggcatctgagggaaagtggtctgagaggagcaggattatgaggacccgcactcctacgaggaaagggtcagaaaggaacggggcgtgaagacacaggctccggagagttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctacccca

SEQ ID NO: 80587 - DNA, 687 bp, Homo sapiens
cggggagcggtgccggaagtagtcggggagggccgcgcagtcggaccggctgctgagacgaacgcttcactggggcagtctctgcatatcatggggagatagacgctgctgcctttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagtgaggaatggcatgatccgtggggacagccagggctgat

SEQ ID NO: 80588 - DNA, 893 bp, Homo sapiens
  misc_feature (678)..(678): n is a, c, g, or t
  misc_feature (689)..(689): n is a, c, g, or t
  misc_feature (698)..(698): n is a, c, g, or t
  misc_feature (702)..(702): n is a, c, g, or t
  misc_feature (704)..(704): n is a, c, g, or t
  misc_feature (712)..(712): n is a, c, g, or t
  misc_feature (717)..(717): n is a, c, g, or t
  misc_feature (722)..(723): n is a, c, g, or t
cggggagcggtgccggaagtagtcggggagggccgcgcagtcggaccggctgctgagacgaacgcttcactggggcagtctctgcatatcatggggagatagacgctgctgcctgtagcttttgaaaatggctgcctctcatttcaccgggctcacagctgttgctgatgtaattaaagatctagacactcagatagctttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggacctgtggagtccaggattggtntgagaatcganctaaaaagntggncnagaagtcnacagngatgnnttgtcggaacaaccgataaccggagcggggtgggcgcgtttggaactggggaaacccactccggggtttggctcgcaggccattttaggagatatggggggggaaacacagtcgcagaggaaaaattttcagacgggagagtcccgtgtcttgacatcaggtcgcagcat

SEQ ID NO: 80589 - DNA, 636 bp, Homo sapiens
caaaaccatggttgggttatacacttcctattagggcgccagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctaccccaacttccggtcccttttccctgccatctcaaagaggagcaatgtatcttccagagaagattttatttgtggtttattatataagtgactgaatatgggacaaagcattatggtctttttgggtaagacagtattagcaggatttgtaaagggttttgtttccttctcccttccccttttccctgtactttgtaatgtcagtgtttatatgaatatgactttcatttgcttttccagaataaagaggtggcctcgttggcctcagcggtggagctctgctggccga

SEQ ID NO: 80590 - DNA, 1091 bp, Homo sapiens
ttttactctcaagattcatcctttattacaggttcttctagagctaattcttgtgcttttcttctccagttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctaccccaacttccggtcccttttccctgccatctcaaagaggagcaatgtatcttccagagaagattttatttgtggtttattatataagtgactgaatatgggacaaagcattatggtctttttgggtaagacagtattagcaggatttgtaaagggttttgtttccttctcccttccccttttccctgtactttgtaatgtcagtgtttatatgaatatgactttcatttgcttttccagaataaagaagttattaatcgaaaaaaaaaata

SEQ ID NO: 80591 - DNA, 1096 bp, Homo sapiens
cggggagcggtgccggaagtagtcggggagggccgcgcagtcggaccggctgctgagacgaacgcttcactggggcagtctctgcatatcatggggagatagacgctgctgcctttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctaccccaacttccggtcccttttccctgccatctcaaagaggagcaatgtatcttccagagaagattttatttgtggtttattatataagtgactgaatatgggacaaagcattatggtctttttgggtaagacagtattagcaggatttgtaaagggttttgtttccttctcccttccccttttccctgtactttgtaatgtcagtgtttatatgaatatgactttcatttgcttttccagaataaagaagttattaatcgaaaaaaaaaata

SEQ ID NO: 80592 - DNA, 1045 bp, Homo sapiens
cggggagcggtgccggaagtagtcggggagggccgcgcagtcggaccggctgctgagacgaacgcttcactggggcagtctctgcatatcatggggagatagacgctgctgcctttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctaccccaacttccggtcccttttccctgccatctcaaagaggagcaatgtatcttccagagaagattttatttgtggtttattatataagtgactgaatatgggacaaagcattatggtctttttgggtaagacagtattagcaggatttgtaaagggttttgtttccttctcccttccccttttccctgtactttgtaatgtcagtgtttatatgaatatgactttcatttgcttttccagaataaagaagttattaatcgaaaaaaaaaata

SEQ ID NO: 80593 - DNA, 1214 bp, Homo sapiens
cggggagcggtgccggaagtagtcggggagggccgcgcagtcggaccggctgctgagacgaacgcttcactggggcagtctctgcatatcatggggagatagacgctgctgcctttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagatgctcctgctgtgggctgggatcatgtgtctgcctctgactgcagttaaatccagatgtcagctgacttctgccatgacttctgccacagattcactgtgtaacctggggcccaacctccgagaccacccttaaacatcagtagactgggagctgtacgtggatggaagcagcttcgccaacccctgcaaagtgactctgaagaagatggcaagccctgttccagtcacacccggaagctgactggtccacgcgcggccaaagcatgaggaaactcatcgcgggactcattttccttaaaaatctggacttgtacagtaaggacttcaactgaccttcttcagactgagggctgttcccagtatatacatcaggtcactgaggtaggacaaaagagtgctacagccctattattttatagtttttatgaatgcctaggaactccaaaaggaacctgttcgtacaataacattcagtacaaagtatgtaatccaggaagtgaccagtccgatgtgtgctatgacccctctgaacctcccatgatcacagtctttgaagtaagacta

SEQ ID NO: 80594 - DNA, 475 bp, Homo sapiens
cggggagcggtgccggaagtagtcggggagggccgcgcagtcggaccggctgctgagacgaacgcttcactggggcagtctctgcatatcatggggagatagacgctgctgcctgtagcttttgaaaatggctgcctctcatttcaccgggctcacagctgttgctgatgtaattaaagatctagacactcagatagctgtaagtaagtttgaggctactgtgagcagaacttggtgaatgtgcttctgatcgtgatgacacccaagctgacgtccacagagtcagcctcatgactctaagattcaggagtctcagctgctccagactagggtctctgcatgtacttagattgctaacactcagagaaaaattgctcttgataaagaggagtttacttttaacagctgctaaaagttatgtttattgggcatagccctgacatagacttaagcatgtttgaaatgccagaatgaa

SEQ ID NO: 80595 - DNA, 410 bp, Homo sapiens
tagtcccagctacttgggaggctgaggcaggagaatcacttgaatccgggaggcagaggttgcagtgagcctagattgcaccattacacttcggatactccatcacacacacacaaaaaacagacctgggttgtagttccaacggccacttactgggaagagagagaccctgtgtagaggtgttggactcagtttattctagtaggcccaacctccgagaccacccttaaacatcagtagactgggagctgtacgtggatggaagcagcttcgccaacccctgcaaagtgactctgaagaagatggcaagccctgttccagtcacacccggaagctgactggtccacgcgcggccaaagcatgaggaaactcatcgcgggactcattttccttaaaaatctggacttgta

SEQ ID NO: 80596 - DNA, 1473 bp, Homo sapiens
cggggagcggtgccggaagtagtcggggagggccgcgcagtcggaccggctgctgagacgaacgcttcactggggcagtctctgcatatcatggggagatagacgctgctgcctgtgagtcttgggccctggcagttgaggaacaagagcgggaggagggagtcaggacccagacctacagtgggtcagtgttcgaaggaccaggttgtggacgagacggggctgtgaggattcaggctcttgggaagggactgactgagaggatcaggctcggagaagacgcggctgtggggacccgggctccaagacgggacttagggaacggggacggatgcgagttctccggcatctgagggaaagtggtctgagaggagcaggattatgaggacccgcactcctacgaggaaagggtcagaaaggaacggggcgtgaagacacaggctccggagagttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctaccccaacttccggtcccttttccctgccatctcaaagaggagcaatgtatcttccagagaagattttatttgtggtttattatataagtgactgaatatgggacaaagcattatggtctttttgggtaagacagtattagcaggatttgtaaagggttttgtttccttctcccttccccttttccctgtactttgtaatgtcagtgtttatatgaatatgactttcatttgcttttccagaataaagaagttattaatcgaaaaaaaaaata

SEQ ID NO: 80597 - DNA, 1068 bp, Homo sapiens
  misc_feature (33)..(33): n is a, c, g, or t
ggtgaagggacagtccagggtcgacgccgaggnacaggaaaagctattaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctaccccaacttccggtcccttttccctgccatctcaaagaggagcaatgtatcttccagagaagattttatttgtggtttattatataagtgactgaatatgggacaaagcattatggtctttttgggtaagacagtattagcaggatttgtaaagggttttgtttccttctcccttccccttttccctgtactttgtaatgtcagtgtttatatgaatatgactttcatttgcttttccagaataaagaagttattaatcgaaaaaaaaaata

SEQ ID NO: 80598 - DNA, 560 bp, Homo sapiens
tgggtgacagagcaagactccatcttaaaataaataaattaattaattaattaaaaaaattaatgaacctgcatttcccagattccctgcagtcataagtggtcctctaagttttggccgaaagagacctgagaagtgattgcaacttcagaatcactatttttttttttttgaaatttatacaaacttttttttgttggagtatacatataggaaagtacacaaatggtaagcttagtgaattttcacatgtggacacactcatgcatgggaacatatgccatccagatcaacaaataaaacaattgcaccattgcatcctgtactccagcctaagcaacagagtaagaccctgtctctaaaagaaaaaaagaaaaagaaatagaacatttccagatctcagaagtcttctcttgtcactatcccttacaaaggcaacctgacttttaataccatagattaattttgtctgtttttatactttatataaatgtaatcaatcaatatgcaatcttttgtgtcagcttcttttgctctacattatacttgtgagattcatc

SEQ ID NO: 80599 - DNA, 1178 bp, Homo sapiens
  misc_feature (4)..(4): n is a, c, g, or t
  misc_feature (437)..(437): n is a, c, g, or t
aaanacatagagtatgaggccactaaaaccccaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaaanaaaaaaaaaaaaaaaaaaaaaaaaaaaaaaaaagggggggggcgccaaaagaagtactcccagaggggaggcgcccaagtacaccgagaatccccagagatttttgggaaccaagggggcgccccaaaagagagaggcaggaatattaaaacgcgcaacggagcttggcgacgagagtataaaacacgctcagaaagcggggagaaaagcgggaacgcatgagggaaaccttggaggagaagagagacaccactcaatatcgagacggggggggcgagaacaacacatgtgggcaccaaactcccacacagaagagagaaattaaagcgcccaacagggggagaaaaacttaaaaacactttacacgagttgacaacagggcgcagcacaaacaagcgggcgcatatagaacacggcgcaggcgcgtagaaaagattggggaagcaacaggaggaggagaaatgaatcatagaggagcaaatattataaccagggaggagtgctggcgagtaaaaaaataggcggggagagaggaagacgaacacagccagacctcggcgcggccgcaacggcaggacgaagggaaccgagccggaggaggagggagaatgggaaagcgccacgacgcggcgggcggggaagtcaggaggcgacgacaaggtgcagagatgaggacgcggagggaggagacaggagcaggacgcagaaaaccatgaaagagggaacgagagacacagaaga

SEQ ID NO: 80600 - DNA, 1165 bp, Homo sapiens
  misc_feature (424)..(424): n is a, c, g, or t
atgtgtagacaagtcatgagtacgttgccaagagggggcgttacttttcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaaanaaaaaaaaaaaaaaaaaaaaaaaaaaaaaaaaagggggggggcgccaaaagaagtactcccagaggggaggcgcccaagtacaccgagaatccccagagatttttgggaaccaagggggcgccccaaaagagagaggcaggaatattaaaacgcgcaacggagcttggcgacgagagtataaaacacgctcagaaagcggggagaaaagcgggaacgcatgagggaaaccttggaggagaagagagacaccactcaatatcgagacggggggggcgagaacaacacatgtgggcaccaaactcccacacagaagagagaaattaaagcgcccaacagggggagaaaaacttaaaaacactttacacgagttgacaacagggcgcagcacaaacaagcgggcgcatatagaacacggcgcaggcgcgtagaaaagattggggaagcaacaggaggaggagaaatgaatcatagaggagcaaatattataaccagggaggagtgctggcgagtaaaaaaataggcggggagagaggaagacgaacacagccagacctcggcgcggccgcaacggcaggacgaagggaaccgagccggaggaggagggagaatgggaaagcgccacgacgcggcgggcggggaagtcaggaggcgacgacaaggtgcagagatgaggacgcggagggaggagacaggagcaggacgcagaaaaccatgaaagagggaacgagagacacagaaga

SEQ ID NO: 80601 - DNA, 1809 bp, Homo sapiens
  misc_feature (1068)..(1068): n is a, c, g, or t
atgtgtagacaagtcatgagtacgttgccaagagggggcgttacttttcttacaaatttggagagaaagtggcaacaccttgagcaaaataattttgcgatgaaagaattcccttctttgacccattcaaggatgtctctgcctggagaactagatcctgactcagtggcagcataggttctcccccagggtggtgctgaacttcagctcagaagcagcctggaccccatcttacctccagataaggtgttttaggtactctgttgccagtgttagtgcaacttagtttaaaaatagaggacttgttcacagtatgctctaagtctcacactggagttttgtgcaacataaagtaggtgattttggagcagagcgaagtctagaaatttgccttaaattatttgtggtactctagagaacgtggtatgtgtatgtgtgtatgtgtgtttgaatataggaactagttcattgaacgttagattgttctaagaccagaattagattaaaaatgcataacatattaagtattaaaaagtgtttatattgtatatgaattttttgcggtaagtttagcttggcattttaggttttaattgatgcttaatctgttaaaatgatgtactgtattttaaagtattctaattgtgcttttttgtaccatcttcagtatgaaaaatgtcagtatttagttcctttctcaggcacaattagatttttattgacattgttttcccccttaactcatgtaattagtcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaagcttacttttggagtttacctaaaatttctgaatgttataatttttgtggcctcttttaagaatgatattttaaaatagtaaatagttcaataaatggtttgcatattaaaaaanaaaaaaaaaaaaaaaaaaaaaaaaaaaaaaaaagggggggggcgccaaaagaagtactcccagaggggaggcgcccaagtacaccgagaatccccagagatttttgggaaccaagggggcgccccaaaagagagaggcaggaatattaaaacgcgcaacggagcttggcgacgagagtataaaacacgctcagaaagcggggagaaaagcgggaacgcatgagggaaaccttggaggagaagagagacaccactcaatatcgagacggggggggcgagaacaacacatgtgggcaccaaactcccacacagaagagagaaattaaagcgcccaacagggggagaaaaacttaaaaacactttacacgagttgacaacagggcgcagcacaaacaagcgggcgcatatagaacacggcgcaggcgcgtagaaaagattggggaagcaacaggaggaggagaaatgaatcatagaggagcaaatattataaccagggaggagtgctggcgagtaaaaaaataggcggggagagaggaagacgaacacagccagacctcggcgcggccgcaacggcaggacgaagggaaccgagccggaggaggagggagaatgggaaagcgccacgacgcggcgggcggggaagtcaggaggcgacgacaaggtgcagagatgaggacgcggagggaggagacaggagcaggacgcagaaaaccatgaaagagggaacgagagacacagaaga

SEQ ID NO: 80602 - DNA, 745 bp, Homo sapiens
caggaggcagcaagcagctgttgagaacatgtgttgtgaagttgtaacagatatttccttaaaagttgtttcctattcccttctttgacccattcaaggatgtctctgcctggagaactagatcctgactcagtggcagcataggttctcccccagggtggtgctgaacttcagctcagaagcagcctggaccccatcttacctccagataaggtgttttaggtactctgttgccagtgttagtgcaacttagtttaaaaatagaggacttgttcacagtatgctctaagtctcacactggagttttgtgcaacataaagtaggtgattttggagcagagcgaagtctagaaatttgccttaaattatttgtggtactctagagaacgtggtatgtgtatgtgtgtatgtgtgtttgaatataggaactagttcattgaacgttagattgttctaagaccagaattagattaaaaatgcataacatattaagtattaaaaagtgtttatattgtatatgaattttttgcggtaagtttagcttggcattttaggttttaattgatgcttaatctgttaaaatgatgtactgtattttaaagtattctaattgtgcttttttgtaccatcttcagtatgaaaaatgtcagtatttagttcctttctcaggcacaattagatttttattgacattgttttcccccttaactcatgtaattagtcatagcaaccaagagtcaagagag

SEQ ID NO: 80603 - DNA, 3057 bp, Homo sapiens
atgtcactctccagtcccagcaagggggaggtacatggaaggccacaggaagaaacaagatcttgagctgagcaagaacatcccagcatcttcattgactttaaaagtatattctggagtcttccgtggttcactattccagtactacagagattccttatattacatggcaggaggggggtaaactgagggatagtgaagacaacaataaattaatcaagagctttcctcatatctcagaacctatcctctgtaagaatgtcagaaaaggttgactggttacaaagccaaaatggagtatgcaaagttgatgtctattctcctggagacaaccaagcccaggactggaaaatggacacctccacggatcctgtcagagtgctcagctggctccgcagagacctggagaagagtacagcagagttccaagatgttcggttcaaacccggagaatcatttggtggggaaacgtccaactcaggagacccacacaaaggtttctctgtagactattacaacaccaccaccaagggcactccagaaagattgcattttgagatgactcacaaagagattccttgccagggccccagggcccaacttggcaacgagagttcagtagatgaagtttccttctatgctaaccgcctcacgaatctagtcatagccatggcccgcaaagagatcaatgagaagatcgatggctctgaaaacaaatgtgtctatcagtcattgtacatgggggaatgaacccacacccaccaaaagcctcagtaagatagcatcagagcttgtgaatgagaccgtctctgcatgttccaggaatgctgccccagacaaggctcctggctctggagacagagtctcaggatcatcacaaagtcccccaaatttgaaatacaagtccactttgaagatcaaggagagcaccaaagaaagacagggtccagatgacaagcctccttctaagaagtctttcttctataaggaagtgtttgaatctcgtaacggagattatgccagagagggtggaaggttctttcctcgggagagaaagaggtttcgagggcaggaaaggcctgatgactttacggcttctgttagtgaagggatcatgacctatgctaacagtgtggtatctgatatgatggtctccatcatgaagacactgaagatccaagtgaaagacacaaccattgccaccatcctactgaagaaggttctgctcaagcatgcaaaagaggtggtctcggatctcatcgactccttcttgaggaatctccacagcgtcacagggaccctcatgactgacacacagtttgtctcggctgtgaaaagaactgtcttctctcatggaagccaaaaggccacagatatcatggatgccatgctaaggaagctgtacaatgtaatgtttgccaagaaagtccctgagcatgtcaggaaagcccaagacaaggctgagagttattccctcatctccatgaaaggaatgggtgatcctaaaaaccgaaatgtgaactttgccatgaaatctgaaactaaattgagagaaaaaatgtattctgaacccaaatcagaggaggagacttgtgcgaaaactctgggtgagcacattatcaaagaggggcttaccctgtggcataaaagtcagcagaaagaatgtaaatctctaggtttccagcatgcagcattcgaagctcccaacacacagcgtaagcctgcatcagacatttcctttgagtaccctgaagatattggcaacctcagccttcctccatatcctccagagaaacctgagaattttatgtatgattcagactcctgggccaaggacctgatcgtgtctgccctgcttctgattcaatatcacctggcccagggaggaagaagggatgcacggagcttcgttgaagctgctggcaccaccaactttcctgccaatgaacctcctgtagctcccgatgaatcttgccttaagtctgctcccattgtaggtgaccaagaacaagcagaaaagaaggacctaaggagtgttttctttaatttcatccggaacttacttagtgagaccattttcaagcgtgaccagagccctgaacccaaggtgccggaacagccagttaaggaagataggaagttgtgtgaaagaccgttggcgtcttctccccccaggctatatgaggatgatgagacccctggtgccctttctgggctgaccaagatggctgtcagccagatagatggccacatgagtgggcagatggtagaacatctgatgaactcagtgatgaagctgtgtgtcatcattgctaagtcctgtgatgcttcgttggcagagctgggagatgacaagtctggagatgccagtaggctaacttcggccttcccagatagtttatatgagtgcttaccagccaagggcacagggtcagcagaagctgtcctgcagaatgcctatcaagctatccataatgaaatgagaggcacatcaggacagccccctgaagggtgtgcagcacccacggtgattgtcagcaatcacaacctaacggacacagttcagaacaagcaactccaagccgtccttcaatgggtagctgcctctgagctcaatgtccctattttgtattttgctggtgatgatgaagggatccaggagaagctacttcagctctcagctgctgctgtggacaaaggatgcagtgtgggcgaggttctgcagtcggtgctgcgctatgagaaggagcgccagctgaatgaggcggtggggaatgtcacaccgctgcagctgctggactggctgatggtgaacctgtaatcggcaaccccactgctttcccctcttctggcagtggggccggcccttatccccgcccttctttctcacttccacatctccccctctatatcctcacagagccctaacattatcttcacaccactctcatcaaagacatgtcatcttgtgctagccactggattttgcagattttcctgtccatgcaagcaaggacgtaaaattaaaaaattacaattaaaggcatccaaaaaaaa

SEQ ID NO: 80604 - DNA, 497 bp, Homo sapiens
aattgtaattttttaattttacgtccttgcttgcatggacaggaaaatctgcaaaatccagtggctagcacaagatgacatgtctttgatgagagtggtgtgaagctacttcagctctcagctgctgctgtggacaaaggatgcagtgtgggcgaggttctgcagtcggtgctgcgctatgagaaggagcgccagctgaatgaggcggtggggaatgtcacaccgctgcagctgctggactggctgatggtgaacctgtaatcggcaaccccactgctttcccctcttctggcagtggggccggcccttatccccgcccttctttctcacttccacatctccccctctatatcctcacagagccctaacattatcttcacaccactctcatcaaagacatgtcatcttgtgctagccactggattttgcagattttcctgtccatgcaagcaaggacgtaaaattaaaaaattacaattaaaggcatccaaaaaaaa

SEQ ID NO: 80605 - DNA, 797 bp, Homo sapiens
ccctgacagggtatcattcattcaaagcatatttgtttcatttgtttttattcctaccttaagccatcttggtgggttctgggtggtctatgcatatgtgtgtgtgttttaattgcagtaagaatattgaatatgagatctaccctctttaattttttttttttttttttttgagatggagtcttactctgtcacccaggctggagtgcagtggcttgatctcggctcactataacctccacctcccaggttcaagtgattctcctgcctcagcctcccaagtagctgagactacaggcgtgcaccaccatgcccgttagtttttgtatttttagtagagacagggtttcaccatgttggccaggctggtctcaaactcctgacctcaaatgatctgcccacctctacctccaaagtgttgggattacaggcaatgagccaccacgcccgggttaccttctttaatttttaagtacacaatacagtattgttaactatagccacagtgttgtacagcaaatctctctcacctatgcatcctgcgtaactgaaactctgtgcccattgaacagcagctcctcatttcctcccccatcagcccctggcagccatcattctactctctgcttctgtgagtctggctattttagatcccttatagaagtggaaacgcgcagtatttgtccttctgtgactggcttatttcattgagcataacgacccccaagtttagccatgttgttgcttatggcaggatttccttcttttttcaggctgaataatatttccttatatgt

SEQ ID NO: 80606 - DNA, 506 bp, Homo sapiens
aactcctgggctccatcagtcctcttgccccagcttcttaagtagctgggactgtaggcatgctctaccatgcttggcttggtgacttgtttttatagggcttgtaagacccctgacctccttaaaggacattgattacaagcgggaagcagagagttgatgaaataaatatgctggattttacatactgattgtattgctgtggcctgttgaaggaagtggggggagagaaatgtgcccacagatacagccttgcaaacccatggattcccatccagcagacagttttaatgaagctacatctccatcttgtgacttgtaaaaggcattgctgtaaacgacttacggatttcttgtgcttttgcaaatacagtcttcagtatgaatgttaccgcttgacatttgcctttcaggtcgaatgaaatttaaatgaaggctggcactaatacacctattgattgcaagttcctctcctgtattttaaaatatgctaagaaagaatgttt

SEQ ID NO: 80607 - DNA, 2764 bp, Homo sapiens
accaccccagtgaaacccacagaaccatgtacaccctctaagtcccgaagtgccagctcagaggaggcctcagagtcacctacagcccggcagatccccccagaggcacgtcggctcatagtgaacaaaaatgctggtgagaccctcctgcagagggcggcgcgtcttggctataaggatgttgttctctactgcctccagaaagacagtgaagatgtgaatcaccgtgacaatgctggctacacagccctgcatgaggcttgttcccggggctggaccgacatcctgaacatcctgctggagcacggggccaacgtgaactgcagtgcgcaggacggcacgaggccagttcatgatgcggtggtcaatgacaacctggagaccatctggctcctgctgtcctatggggccgatcccacactggctacctactcgggtcagacagccatgaagctggccagcagcgacaccatgaagcgctttctcagtgatcacctctcggatcttcagggccgggcagagggtgatcccggtgtatcctgggatttttacagcagttctgtgttggaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggccctgcaactggttcctcttttccgatgtcttgaagaggctgaagctttcctcgaggatctttcaggcccggttcccgcactttgaaatcaccaccatgcccaaggccgagttctacaggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactctcccaccccgttctggcctccctgtctcaagatactgagcctctcacctcccagccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgctaaaacaacaacaacaaaaaagaaaatggaaaaaaaaaagattaaaaaaaaaaggaaaaaaaaaaagccagtttgaggatgggacaatctgttctctagaggctcctgagccatgcgggagcattggtggttattttctttgtattgtgtttgttctttgttcctgggggggaagttctcggcccccttctgtaggactgctccccacccccaccatactgcccagttggttttgaacagttgttttccctttttaagaaaaaaaaatacatatatatatacatatatatatata

SEQ ID NO: 80608 - DNA, 6233 bp, Homo sapiens
  misc_feature (802)..(802): n is a, c, g, or t
  misc_feature (1492)..(1492): n is a, c, g, or t
  misc_feature (2975)..(2975): n is a, c, g, or t
  misc_feature (4053)..(4053): n is a, c, g, or t
agtactagaactttcatgtgccctctgaaggatgtgagccatggaaccggcaaaccgcatccctgactaggggcctgtggccttgtcatttacctcccaaccaccacccctccatgcccctttatctgcttagcgcatttcttttcttcggttttgtacatgtatctgagtcctaatcccctatatgctccccttacagaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggtaagtgtccgagagatccacggtgactgagtgtcaggatcctggcactcagtaggaaggtggagttctccacgaggaagtgaagacctggcaacgagtgccatcacacatgacaaaggctagcctgcccttttagcccagagtagtcatgttcaaactagaggctgcaggctccatggacattgactatctgcatttcctgaaccttaaatctagattctctctcggaaggcttttttttggcactattactgggtataaaagataatctgagagatacttgggcctatgaactgctagaatctctggaacatttttgtagtttctgggggtaaacagatagaacattagaaattgagattgctggaaaagccaggacatatggttgccatagccatggggccactagggtccttcagtaatccacagcctagtttctcagtgcngtaatgttagtagcgtggtgctgccaacattgtcagcctagatgactgtgcatattatattggggatcacccatttatttaaggagactagaatatagaatatacctgacacgtaacattagattgaacccaatttaatacttatttgatggttctggagggagttcgacagccggcagggccatggcccttgttgggtttccccacatgtcagcgtgtggaagtgctggttgagagaaggagaatgcgggctgaactgcccttttattcttagcctccatgattttttccctctgattggtgtcttcatgtatttcaaatacttttccgaacaattgtaaggataatttttctttgatatctatttttaaaatgtcaactctatgttaaaatcctgtgaaccagtggctggtcgcagcagttgtaatttcagcactttgggaggccgaggcaggtggattgcttgaggccaggagttccagaccagcctggccaacatggtgaaacctcgtctactaaacatacagaaattaggcgggcatggtggcgggtgcctgtaatcccagttacgagggaagctgaggcaggagaatcgcctgaacctgtgaggcggaggttgcagtgagctgatattgcctgctacactccagcctgggcgacagagtgagactccgtctcaaataaaataanataataaaataagtcagtgaaccagcatgatgtgcacaggatggggagctaggtagacgatggatgaggaggtctttaagtgagagcctctgtttagggctctaaccattagaccacagtttctttgcatcccctgccctcccccccaccaccccacacgcatagcctgatcagaataaaaatagcatgtatgatggcactagtagggatcaagtttcaggggcttttggtccttattcttctgggcataagctgatccctgaggacagggcggggcctctgggatatagtattgcacggttaattaattcctccgatgtattcagcacctccctctctgaaacaggatcttgggcttcaggcagtaaaaggaccagggtagtctgcattaggtgcagacagaacacgggccacggagggctgcgtgcccctcagcgagctgagtggcaggcacgtggttagcccagagcccggtaccagcaaagctggttttcctgacgtgacatcctctagcgctcgctctagagctgcctttccccacagctgcagcacactgtgaaaatgtctgttcttcaagaagttgggggtgggggtgctagcgtagagtgatgcctctgaggccctatggggtgcagaagggccttctgaatcaccaaagcaagactgaattctcatcactagtgtgaatgttctcagggcttttttccattctttggaagtgatggtccaagtgtatgatatctgtagtccccttttcttaacccagagccctccatttcctactcatgtgagataagagcttgctgtcatttgggagaaatgttccattttagggataaggatcgtgggtctggttagatgtttaaggtgctggaacagaacatttgattctataaacatgtcttaaacagctgcaccaggtcaaaccctggggaccttcaaagaatccaccatctagtgcagtagacagacaagtatataattaactctaataaaagacaaaatgtcctaagcagatttattataaaaaactccaacagtttcagaagggtgtcaaatgcaaaaagttccagtccaccctgagcccccattgctatgctgcagagtgaaccacagtttaaggttcttttgcaaccctttcagaaatgggttttgttagtagtattacaatagggatgtgaatcaaatgccacgagaccatgggagatggaagaacaatgagttacaccgggggaaggtttcacaggtgatacagtatctacctgagctgggcctggaaggagagaaggatggagcaaggcactgaaacatacaagttcagaaagtagggggagtcctttatcatgtggctggtgcttggtagggtgggggatacaatgtggggtgtgtgtgtgtgtgagagagagacagagaaagagagagactgggtggacattgggctgaagaggttagaaggtctcatataatatcatgctagtggccnggcatggtggctcacacctgtaatcccagcgctttgggaggctgaggcgggtggatcatttgacgtcaggagtttgagaccaacctggccaacatggtgaaaccccatctctactaaaatacaaaaattagccaggcgtggtcgtgggtgcctgtaatcccagctactcaggaggctgagacaggagaattgcttgaacctgggaggtggaggttgcagtgagccgagattgcgccactgcactccagcctagagactccgtcttggaaaaagaaaaaaaagaaaagaaaactgtaatggtaacagaagatccagtgagggtgggtgggggtgcagaagagtgactcttggcaaagggaaaccggttaggaggctgacaagacagagcccaggccagaagtggcaaaggctggagctggggtagtggaatagtgaggagggaaaaccctgtgaactgggaccactaatgtggggaggcagcgtttcttcccgcattagtcaatgtaagcgtttggcccgggatcggcctctccagcacccctcccagctgtccccaggctgccacccagtcgggtgtgctcagcaaagtcagactccactttctgtaatgtgagctctggccctgcagaaacgatggtgctgctgctggagaaaaaacttgtctaatgcattccagagccaaagagaaatgccttttggattacccgcagtttaggcctttctccacggctccccctctgctggggaagatcttggagagcaaggaggccagggaagcaagagtaagaacaggagaagggaaggcagccagggttggcaggggcgggagtcggaggaaagactggtcccagcagatggcaaatgccaggtcacaggggcgcaggctaagtccccaagaagcctgctaagagttttaggttctagaatgcccctttgcctcctgtttgtgttattttggaagaggtggtcactgattgcgtgctcaccatttagctgaaagccgggccaggcattgcaggggacaggagaagacatttgcctcagctatacccaaggagcctgtggtttagcaggggangggggagccagactggcagtgagttataatgggagacattgatggtcgtgcagcctttgtgggctttgcagagtgttctgggtcggtgcccccaccgcttcctccagcctccttcaataactcccatccttgcctttgcaggccctgcaactggttcctcttttccgatgtcttgaagaggctgaagctttcctcgaggatctttcaggcccggttcccgcactttgaaatcaccaccatgcccaaggccgagttctacaggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactctcccaccccgttctggcctccctgtctcaagatactgagcctctcacctcccagccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgctaaaacaacaacaacaaaaaagaaaatggaaaaaaaaaagattaaaaaaaaaaggaaaaaaaaaaagccagtttgaggatgggacaatctgttctctagaggctcctgagccatgcgggagcattggtggttattttctttgtattgtgtttgttctttgttcctgggggggaagttctcggcccccttctgtaggactgctccccacccccaccatactgcccagttggttttgaacagttgttttccctttttaagaaaaaaaaatacatatatatatacatatatatatata

SEQ ID NO: 80609 - DNA, 214 bp, Homo sapiens
tggcagtctctgactgagaacaggaagtgtgtgtctctctggtcactcctggactctcttgtggtccttccttcccttctcccattcccttagccccgtatgcatggacttcacttggacattccttccccagcctaacctccttgtctcactgcctgctcttctttcatcagatcacctctcggatcttcagggccgggcagagggtgatccc

SEQ ID NO: 80610 - DNA, 288 bp, Homo sapiens
cctaagactaaatctaacacaataggtagagctattatacaaaaatagtttagttttgtcctttctttcagagaaagctaaagacaactgtagcaagatattaacaacttctattttctaggaacagatatagccagtcacaacaggaacaagtactgcatgattctatttgtatgaacgatttaaaatagaagcagagagaatggtggttgccaggatttagggaaaggggaaatggggaattgctattcaatgggtatgaagtttcagttatgcaaggtgatttct

SEQ ID NO: 80611 - DNA, 724 bp, Homo sapiens
ggctgggagcctgccaggctccgggcagcaagtgggagtttgaggaagggaagacatgcaggctggcaagagctgacagagctgtgcaggtaccagaggtgaaggtgggaacataggtgtagggggctttctggtggcttctctgttctcccagctccctggccttagatcactaaggagcgccgtctgggcgggcttgaggcaaagggagtggagtcaggaggagattcagtaaggaaaaagatgctagagcctccagagcctgtggtgggggctgagtgatgcccccagctgtgagtccctctgggtccttggcctcccggcagtcctcttaggggcccttaagggagagtcccaatcttcctccccatggagtgggtactggctccacaccctgaaggcctgggggggccacatctgctgggtttggggagacgctctttctgtctatgaggggctgtagaagctaccttcctgggcagtgacagctgcttctaagcagtccttgtccttgcgctccatgtttttggagggaggtgacatgtgagaagttgggggcacccatcctgaggggcaggttccaagaactcttgggccctgtcagccctgcaccctggagggagaagggaaggggcctgcccagggtcacaggtgagcgatccagaaccgagactgcatcccctgggactcccagcttagtgctccctcggcatcaccctcccca

SEQ ID NO: 80612 - DNA, 585 bp, Homo sapiens
tacagtattattacaacaatgaaagaacagaagaataaggttttgagaatgtcattgtcagaggagagagagcctattgtaaaattcctagactgtggttgaattgattcttgctgaacatatgacgctaccccattagtacatgtacgttgaatggatttttccccctagaatttcacaatcaagagataatcatttgctctttttaaattgttgttcaaaatagtttctctcatgactaaatgaagtcatccttaatatcactgtgagaagttaggtatgtataacttgggcctgaagcaaggaaagttgtttgcttacatgaaaattatgtatacgtattttacgtgaaactgcctttgccacttttatgtaatgtcattttatatctcctatagatctcatctattcacattcttcaacaatgcatagatcttttatctcatcatacatatgccatggttgcacattcaattcatgtgctgaggaagatcaggtctcagtctccagtcttccctcctgagttccagatacatatggatgtcttctatacctccacattccacccaaacctcactattcaca

SEQ ID NO: 80613 - DNA, 479 bp, Homo sapiens
attaacaactttgtgttaaaatgctatggcatgtatttatcccttaaaaataatccattttctctggaaaagctacaaaaggaagtggcaccagttgttacctctagagagaggaactgggtatctagggtgggggtggggtgagtaggagacattcttttcaatgtataccctttcatttattttgatttttgaattatgtgctggtaactttaattgaaaaaatgttgtattaagtaaaacacatagaaaagcatacacatatattgcttaatgaattattataaaataaatacccttctaatatgtacctaggtaaagaattttcttagtcattgcagaagccctttcacagccttgtcataacctcttttctcctccccaaagtaaccactattgtgactttgaccacttccttgcatttctttatagttctgtcaaccagatgtgcatccttagacactatagtcttgcccatt

SEQ ID NO: 80614 - DNA, 434 bp, Homo sapiens
ccactgtgcttggccaaacacatcattttaaggcataaatattgcctgaaaagtagcagagagaaaaatcttgatcgagttacatttaaaaagttataccaacgagaacagacttactgtgacatccattatgataagtcataaaaatacataatagtggcttggaaaatgctttctataaaacagaaaaaaatcccctatttctatgggcctcactattctcatttgtaatactagattttagattacattctatcagtcccactttgactctaatatttggatataatcaataattaataattcactatcagatattgatcagcaccatttaatttgataaaactaatcctgaacatgggcagggattggattactgcttctttatatctttaccaagtgcatcatgccgtgcatatcttaagtagccccca

SEQ ID NO: 80615 - DNA, 257 bp, Homo sapiens
ccaccatcttgaaatatcattattcatttccattacttcttggatgttctggttcactgctactgggtttcgcaacagtgtggagaagagaccatgacattgaattaccggctaagcagcatccataagtgttatattcctcccttaattatgatgagaacttgtgtttaggaagctgtgatgtttactgatatggttaatggtcaatgtcactcatcaaaagggtgataagacaataatgggatcttggaacaggg

SEQ ID NO: 80616 - DNA, 86 bp, Homo sapiens
agtactgcccgtcccgcccctcctctcgagcctcagcgctcagcatcgcccggaccccctcttcccttcgcccgcctcgtcccgac

SEQ ID NO: 80617 - DNA, 336 bp, Homo sapiens
ttttaaatgcagggaatgaaagtgaattattatggggaccctatacaggtttttactgtaaaaatcatatatgtttatatgtatattaaacatattttatacatatatctatacatatatgtttatatacatatatgtctacatatagtttatatttttataaactataaatatatagttatatacacaatttctacattagactatagtactataatttttttaaaatatcaggaatttctagaaatgaattaataccctgttattttctgtgattttcattattctctatttcaatcattacaaaagaataaatgtaaaaacatagaattcttt

SEQ ID NO: 80618 - DNA, 93 bp, Homo sapiens
tgattcttctgtttcaggcgtcctgaacagaagtcacttaattatattcagctgtgaatgggttggtttagagtatttgagtggctgttgact

SEQ ID NO: 80619 - DNA, 361 bp, Homo sapiens
aaaactgactgggaggtgaaggaacttgttcaagggcacagagctggacatggcacaggtcggttgaattccaaagccacactccttccaccatgctgtttcccggccaaacccatttcaagcaaggtttcccagatttctgaaaacccatcctcaggcccttctcgctgagcttctgattctgtatgtctggatggatcctgaggtccgcgtggaacgggtaccaggtgttgttcataagcagggacagttgaacacactcgtctgagcacggggaagttccgccacacaaatctaaccacagcaacaccgcgatatggctacagcctccgaagggatagtgacaagatctcccccaaag

SEQ ID NO: 80620 - DNA, 369 bp, Homo sapiens
tgggaagcttcgcccctgtagtttgcatagtacagcctccacagctgctcttatgggctagagttgagtgcctgtggcttttccaggcacagggtgcaagctgccagtggatctaccattctcaggtctggagggtggtgacccctttctcacagctccaccaggcagttccccagtggagactgtgtggggccttcaaccccacatttcccctccaaactgccctagtaggggttctctgtgagggttccacccctacagcaggcttctgcctgggtaccctggctttcttgtacatcctctgaaatctaggtagaggctgccaagcctccttcactcttacagtctgcatgcctgcatgcttaacac

SEQ ID NO: 80621 - DNA, 527 bp, Homo sapiens
tgaaaggaggacaagctgtgtttagaaaatgaaaaaaatattttgtttgcataatagggtatgtaggttaaaagtagactataagggctaggcaacaccacgcctgtaatcccagcactttaggaggctgaggcagtgggatcacctgggtcgggagttcgagaccagcctgaccaacacggagaaaccccgtctctactaaaaatacaaaattagcctggcatggtggtgcatgcctgtaatcccagctagtcgggaggctggggcaggagaatcgcttgaacccaggaagcagaggttgtggtgagctgagattgcaccactgcactccagcctaggcaacaagagcgaaagtccatctcaaaaaaacaaagaggaagaaaaattagccgggtatggtggtacacgcctatgtaatcccagctgcttgggaggctgaggcagtagaatcacttaaacctggttgcagtgagccgagatcgtgccactgcacttcagcctgggcaacagagcaagactccatctca

SEQ ID NO: 80622 - DNA, 772 bp, Homo sapiens
  misc_feature (20)..(20): n is a, c, g, or t
  misc_feature (29)..(29): n is a, c, g, or t
  misc_feature (59)..(59): n is a, c, g, or t
  misc_feature (131)..(131): n is a, c, g, or t
  misc_feature (143)..(144): n is a, c, g, or t
  misc_feature (176)..(176): n is a, c, g, or t
  misc_feature (206)..(206): n is a, c, g, or t
  misc_feature (737)..(737): n is a, c, g, or t
aaagcatcactgccttggcnccttccttncggctgccccccatcacctcaactgtctcntccctgggctaagcagggaaaaccgggctggggtagctggatgtggccaaagtccactgtcctccttggcgncaaaagcccatnnagaagaccagcccagcctgcccccctcttgcngccgttcccggcggcaagaggcagaggagncggcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctcttgccgccggggnatcctctagaggcgacctccaaagggcaattaaaa

SEQ ID NO: 80623 - DNA, 2468 bp, Homo sapiens
ggcggaaggcggggtcggccctggccccgcccacatcatttcccttcctcggcccagccccacagcgcgcagcttcggcagggtggctttacggccggaggagagggtgggtcccagacctgaggtaggaggccgagctgaggggcggggaagaggctttttgcggcaggacgtaagtgacggcgaaggcggtgcgacagcagctggagggcagaggaggcggcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattattcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagagatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaaacagagcaacacacgcgacaaacgcagacacaacgcaacaaacaacagggaggcacgacaacaaagaaaccaccaagaggaccccgaaaagagacaacacatacgacacacaggggcccaaagggcgacaacaaacagacgagcggaccaccagcaacacacgcacccccaccaaccaaacgagcagcagcgaacccacgcgacagacacacaacaccgagcggggacacaaacgagcgaaacacacacataacaatagagcagcggacaacaccacaccagcgccatcagcggacaccacacgcacacacgacggcacagacacagcactgtatgaacacacccgacccgactgacaccagcagacgacccgagaacacacggcagcacacagaca

SEQ ID NO: 80624 - DNA, 2020 bp, Homo sapiens
ggcggaaggcggggtcggccctggccccgcccacatcatttcccttcctcggcccagccccacagcgcgcagcttcggcagggtggctttacggccggaggagagggtgggtcccagacctgaggtaggaggccgagctgaggggcggggaagaggctttttgcggcaggaccgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattattcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagagatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 80625 - DNA, 2017 bp, Homo sapiens
ggcggaaggcggggtcggccctggccccgcccacatcatttcccttcctcggcccagccccacagcgcgcagcttcggcagggtggctttacggccggaggagagggtgggtcccagacctgaggtaggaggccgagctgaggggcggggaagaggctttttgcggcaggacgtaagtgacggcgaaggcggtgcgacagcagctggagggcagaggaggcggcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattattcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagagatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 80626 - DNA, 1658 bp, Homo sapiens
gaaaacgaattcccactgcctattttgagatctcactaacacttaaagggaaatctgatgaagtttgtaagaagctgtggtgtttctttctgtcaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattattcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagagatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 80627 - DNA, 1653 bp, Homo sapiens
ttcagtatctctctgccttgttcatgaactagaaaacatcccttctgcctatgtgctgtaatctctagaaggaacacaggagagaacttgggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattattcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagagatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 80628 - DNA, 1235 bp, Homo sapiens
cccgggctgcaggattcggcacgagaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattattcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagagatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 80629 - DNA, 939 bp, Homo sapiens
ggtgacatatagaacagttggtttcaaaaagcaggctggtaccgggctccgggaaattccccggggaatattcggtcgaaacccagctcgcagttcctcaaactgaagcttattgaaaaaaaaatgtataatgttatttgttttattatagcaattattcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagagatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 80630 - DNA, 1121 bp, Homo sapiens
ggcggaaggcggggtcggccctggccccgcccacatcatttcccttcctcggcccagccccacagcgcgcagcttcggcagggtggctttacggccggaggagagggtgggtcccagacctgaggtaggaggccgagctgaggggcggggaagaggctttttgcggcaggacgtaagtgacggcgaaggcggtgcgacagcagctggagggcagaggaggcggcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccagga

SEQ ID NO: 80631 - DNA, 1336 bp, Homo sapiens
ggcggaaggcggggtcggccctggccccgcccacatcatttcccttcctcggcccagccccacagcgcgcagcttcggcagggtggctttacggccggaggagagggtgggtcccagacctgaggtaggaggccgagctgaggggcggggaagaggctttttgcggcaggacgtaagtgacggcgaaggcggtgcgacagcagctggagggcagaggaggcgggtttgtgtttcccgggccgaaccgggttgtggggggcgcggggcctgggccaggcggcagctaaggcccgcggtgacagcatgggtgaaggggagcggggcagaggaggccttgggctgttttcggcggcgggtgggggcgaggggctggcgggtcagagtcccgggtccaggccggggctctgactcgcggttggtgttcccccgaccccgcagcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccagga

SEQ ID NO: 80632 - DNA, 402 bp, Homo sapiens
gaacttaagttgctggcccaaggacaaacagctagtagacagcagtcaaggcagcgtggctccatggtgatgtgcttggtcagagatctgaatatataggacttagatttgtagactattgagctgtagactcatttagacaaatggtaccaagatattttagtagataaaattctaggttagtagaacatagaccacatgttataagctgatatcagttgatggaagaaaaatggttttacaagttattttcaggatctctatcaaacctttacttctccctctaattacagatcccacttccagccgggcccctcatgtatccactggccgaccgcagagtgtccctacctcctctccagagcatcattcctttctatctgctgccagagccacggtgcc

SEQ ID NO: 80633 - DNA, 2071 bp, Homo sapiens
ggcggaaggcggggtcggccctggccccgcccacatcatttcccttcctcggcccagccccacagcgcgcagcttcggcagggtggctttacggccggaggagagggtgggtcccagacctgaggtaggaggccgagctgaggggcggggaagaggctttttgcggcaggacgtaagtgacggcgaaggcggtgcgacagcagctggagggcagaggaggcggcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattattcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagagatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 80634 - DNA, 2286 bp, Homo sapiens
ggcggaaggcggggtcggccctggccccgcccacatcatttcccttcctcggcccagccccacagcgcgcagcttcggcagggtggctttacggccggaggagagggtgggtcccagacctgaggtaggaggccgagctgaggggcggggaagaggctttttgcggcaggacgtaagtgacggcgaaggcggtgcgacagcagctggagggcagaggaggcgggtttgtgtttcccgggccgaaccgggttgtggggggcgcggggcctgggccaggcggcagctaaggcccgcggtgacagcatgggtgaaggggagcggggcagaggaggccttgggctgttttcggcggcgggtgggggcgaggggctggcgggtcagagtcccgggtccaggccggggctctgactcgcggttggtgttcccccgaccccgcagcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattattcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagagatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 80635 - DNA, 2057 bp, Homo sapiens
  misc_feature (20)..(20): n is a, c, g, or t
  misc_feature (29)..(29): n is a, c, g, or t
  misc_feature (59)..(59): n is a, c, g, or t
  misc_feature (131)..(131): n is a, c, g, or t
  misc_feature (143)..(144): n is a, c, g, or t
  misc_feature (176)..(176): n is a, c, g, or t
  misc_feature (206)..(206): n is a, c, g, or t
aaagcatcactgccttggcnccttccttncggctgccccccatcacctcaactgtctcntccctgggctaagcagggaaaaccgggctggggtagctggatgtggccaaagtccactgtcctccttggcgncaaaagcccatnnagaagaccagcccagcctgcccccctcttgcngccgttcccggcggcaagaggcagaggagncggcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattattcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagagatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 80636 - DNA, 1552 bp, Homo sapiens
ggcggaaggcggggtcggccctggccccgcccacatcatttcccttcctcggcccagccccacagcgcgcagcttcggcagggtggctttacggccggaggagagggtgggtcccagacctgaggtaggaggccgagctgaggggcggggaagaggctttttgcggcaggacgtaagtgacggcgaaggcggtgcgacagcaagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattattcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagagatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaa

SEQ ID NO: 80637 - DNA, 970 bp, Homo sapiens
ggcggaaggcggggtcggccctggccccgcccacatcatttcccttcctcggcccagccccacagcgcgcagcttcggcagggtggctttacggccggaggagagggtgggtcccagacctgaggtaggaggccgagctgaggggcggggaagaggctttttgcggcaggacgtaagtgacggcgaaggcggtgcgacagcagctggagggcagaggaggcggcgcggggtgtcctgtcctcgccatgaggccgcagcaggcgccggtgtccggaaaggtgttcattcagcgagactacagcagtggcacacgctgccagttccagaccaagttccctgcggagctggagaaccggattgataggcagcagtttgaagaaacagttcgaactctaaataacctttatgcagaagcagagaagctcggcggccagtcatatctcgaaggttgtttggcttgtttaacagcatataccatcttcctatgcatggaaactcattatgagaaggttctgaagaaagtctccaaatacattcaagagcagaatgagaagatctatgctccacaaggcctcctcctgacagaccctattgagcgaggactgcgagttattgaaattaccatttatgaagacagaggcatgagcagtggaagataaaccgaagaattaaagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagccca

SEQ ID NO: 80638 - DNA, 839 bp, Homo sapiens
cttggaatgttctacaaggtttatatcaactgagggttgaaaaatcctacttatccactctccttactttagagatgaggaatttgaatcttagagagtttatgacttatccaattggtggtattaccgaaaaccaaaagccagtttgcttcctagttgaatgttctttccatcatgccatgtggagttattttgagtcaaccagaaaatctgcaaggacatcaaaataatgttctttctccctctgacctcagtaataaccggttaaagatttagaatgctttagagtaaatcctcaaagcagctgcaggtcctcaatgttccagaatagatattttaagttctccaaataaaaaatcccaataaagaccttctttttgcagtaactaaaaaagtttccagctctcctgtcacaaagtggctattgagacttcaaatgtcagatgatctcctttgaagcagcaaaatagagtggatagaactccaggatggatgtcaaaaaactctgtgatcctagttctaactcaaatttacctttcatatggtatgaggttggcaacaaatgattcatggaccaccactcatctatagaccagacattagtaagatgtgcttgcttctccttcgcctttcaccatgactgtaagtttccagaggcctcccagtcatggttcctgttaagcttgcagaacgtgcacacaacctggagcaaagagatgtcaacgtagacttgaaagcctcaacaaacatctatacattcaaaattcagaggataattgcagacttacatgttaaatgatgccacaggcttgtggtgaatgtacaaatctaattcccta

SEQ ID NO: 80639 - DNA, 449 bp, Homo sapiens
tgatttatcctttgaaacagaaagtgcattacatttaactggtcttgcaaagggggttttcttctctttacaaaccgaattccttatataaattaataaaggttaaagatgctaatatatcaccattattagctgtaaaaagaaaacaatttacatattctatagtattcttatgatacaaaacacttcaaattcaattacagtaactaaatgaatttttatgtttcagacccagagcggttgtaacaattcccaccacctactttaacacgcatttttatcagaaaggagttaaatacaagctattgtagcccctccctccccaatattttctttaaatcactaataaatagcaacaaacgactgtgcaatttcagagaggaacagggaggcaggtgagaggccctccctggttcccacgtcttccacttcaagtccggggggcggga

SEQ ID NO: 80640 - DNA, 1103 bp, Homo sapiens
ttaacctcattgctactcttccccttgcctcctaattctctggttaaacttccgcccccgaggtttctagaaatccctgagctggaatgcgctgccttcattaagagggtgttctgcttccgtctgctcacattcatctagtaagccctctcgttaaagaggaggcagcacaccgaggcctgtctagaacttctttcatttaaccaacagtgaatatctaatctacaagaaactggagccgtggcagtttaggagcctgccaaggttgcatccctgggagcttattttctattgtgggagacaggaaaagaacaagtgaatcaactgtgaaattaaataattcaaacttaaagctgttggaactttaaattattctgagccttgcgaagaatgtggcgatggggcctgagtcccatggcatacagctgcaatgtctgccttgttttttcctataatcaggaagaccaaacagagacagaggcgcacacaccaagaaaggccatgtgggcacacagcaagatggtgcctgtctgcaaactaggaaaagagccctcaccaggaactgaaacagctggcaccttgatgttggactttccagcctccacaactgtgagaggtaagtttctgttgtttaaaccacctagtctatgatattttgttatggcagcccaagcaaacaccaacatttgccaattttgatttattttttacatatatgatgtaaaaagtaatctttacaaagtatcatatgtctcattatttcatgcagaaattggtgaccaaatcaaggggaaaaataaagagatcccaaataatacatgcaaattaaatggtttctttatagtttgaagtttaatcaatgaactctaattaatcatttccaaaaatatggcaatcgagacatccaaacaagaattggttagaagtcccctctatgtgcctgggaggcctttctccattctctttttcttatttctacaaacacaaatctgagaagttctataagtttattaaaacagtgggagaaagcatcgttggtcttaataaattgtgtgcactgtgcaacctcttcccccagtgtttgttttactctataaagttct

SEQ ID NO: 80641 - DNA, 596 bp, Homo sapiens
taaatcacacaagtccctggcatgagaccaagaagtcacagagcccaggtcttagccctcagagtgtgagagaagacatgaaggcatcagggacactgtgcgagtgggcactgctgctttccactgctctccctagactgcagccaggaggctgcctctgccctgccaggtcagattcccccaagaggccctcccatagcaccctgggcatatggccgttttgtacttagcactccgaactgtgttgactggtttctctctctctccctcactaatctgtgagcatttttgtaacctccatgctccgtacaatgcctggagcatagatttctcaagaaatctttgttgaaccttttcttcctccatattaaaccagaccttgcatcacaggcactattttctcagtattcagtccttcactcccttctatacacaaataatctccatcctagacaggaaattataggagagaaggcaatctgtgtgagaaagcaatttctatttgaagcacttgtgtgtttaggtgctgctgagaattgcaataaaagccaacactgggcttaaattgttaagcagtatctgttagctagcatttc

SEQ ID NO: 80642 - DNA, 1305 bp, Homo sapiens
cgctccgccgcgctgtgcgaggcccagactgagggcgaaacagcaggcaggactgggtggagacgttcggggacgtggcaactggagtttcttctccgtatatttcggcattcagttcctttttttttttgttttaactcaggaaaaaatctcaattgcgtttagtatttggaaagccactttattgcttcccgagcctcagtcatgtgtggtgggaggctgctgtgggtggcacctggggcgtccacggccgccaaggcgggaggacgtcaggccctgcttgctcccaccccttccaggtgagagctcccgggcacgcccgtccttggctcttcgtcctcttggtgttcttccctgttgcttcaaatcaggttcctgtctcaaaaatccgaaaaagaaatcctcccaaatgactctgtgcccgacgctccgttaaggcatcgtgctaggcgttctcaaactcgtgaaatgactacactgcacaggaagaccaaacagagacagagttctggttaaatcacacaagtccctggcatgagaccaagaagtcacagagcccaggtcttagccctcagagtgtgagagaagacatgaaggcatcagggacactgtgcgagtgggcactgctgctttccactgctctccctagactgcagccaggaggctgcctctgccctgccaggcgcacacaccaagaaaggccatgtgggcacacagcaagatggtgcctgtctgcaaactaggaaaagagccctcaccaggaactgaaacagctggcaccttgatgttggactttccagcctccacaactgtgagaggtaagtttctgttgtttaaaccacctagtctatgatattttgttatggcagcccaagcaaacaccaacatttgccaattttgatttattttttacatatatgatgtaaaaagtaatctttacaaagtatcatatgtctcattatttcatgcagaaattggtgaccaaatcaaggggaaaaataaagagatcccaaataatacatgcaaattaaatggtttctttatagtttgaagtttaatcaatgaactctaattaatcatttccaaaaatatggcaatcgagacatccaaacaagaattggttagaagtcccctctatgtgcctgggaggcctttctccattctctttttcttatttctacaaacacaaatctgagaagttctataagtttattaaaacagtgggagaaagcatcgttggtcttaataaattgtgtgcactgtgcaacctcttcccccagtgtttgttttactctataaagttct

SEQ ID NO: 80643 - DNA, 393 bp, Homo sapiens
tcacttgagcccaggagttcaagactggcctacactgcatagtgagatcctgtctaagaaacgcagagagaaataaattaacagtttaaaaatttaaaatttggggcctggcacggtgggtcacgcctataatcccagcactttgggaggccaaggcaggcggatcacgaggtcgggagatcgagaccatcctggctaacacagtgaaaccccgtctctactaaagaaaatacaaaaaaaatagccgggcgtggtggtgggcgcctgtagtcccagctacttgggaggctgaggcaggagaatggtgtgaacccgggaggcggacgcttgcagtgagccgagatggcgccactgcacaccagcctgggcaacagagcgagactctgtctcaaa

SEQ ID NO: 80644 - DNA, 655 bp, Homo sapiens
ccatgttgcccaggctgctctcgaactcctgagctcaagtgatctacctgcctcggcctcccaaagtgctgggattacaggcttgagccaccacatccagccagaagagagggttttgcacggtctaaagggaggggagatgttgaatagtcggaagagcaaagtccctagagagggcttgaaacaccaaccttggcagcaccaaggttggaggagctcccgccctgcccatgcctgcacatgggttataacattgcagacaccacctcctgtgccatcttgccagtgagtggtcagaaagtgagaagagtgggctcagaggttgggagtgtggtcagtgtcactcactcagggagcacccacggggtcacgtcttgagcccaggtcagccaagctccctacatggggtctcctccccagttctggtcccaaagatgggtggggacagtgcactcctgcccctgccacagccaggcccccttccctgtgtcttgcagcctcccctctacagagaaccatgtccgggcctccctctctccatctgtagccaggtgggggcctccctgctggcactgctgtttggagacttatacctctagctgctcaacctgcttcctctgcatccggggctggacctactgagggcttctgtgcc

SEQ ID NO: 80645 - DNA, 270 bp, Homo sapiens
ggaaaactcaggcttggaacaggtaaccccccggtttccgcaggccacaaatcaccacccgcaaccgaaggacgcgcaggctgggagcggcggcggggccaccagtgcggacctccactgagggcggcgggatccgaccgcaagggctggtccctgaggccactaaggggtgcgctgggctaaggccgcctgggggcaggagccagcgcgatcgtggcgggccagcaggcggggctggctgaggactagcagcgacccgagaccccaacc

SEQ ID NO: 80646 - DNA, 340 bp, Homo sapiens
ttttttagacacagagtctggctctggggcccaggcttgagtgcagtggtgagacgggagaataagtcctagaggaagggaacctgaggacttcccagaactaaatcagatggagaggagagaggaggcatttcagctacgacaggaaatatcctcttcatttgcatagggcgttcaccaaggtgcacaccaaataaccaatggaaacctctagagagtatttaaactccagaaaattctgtgacgggctcttgagccaacgtgctccggccgctcccactctgtgcagtcgactgtacttttgttttcaataaaactctgcttttgtttcttcattctt

SEQ ID NO: 80647 - DNA, 968 bp, Homo sapiens
cggaccaagtgccccctgcactttcaacgccgtaggtctcccggcagccctggaaggacagtcttacccggacgccacggtggtctcccggcagccctgggaaggacagtcttacccggacgccacggtggtctcccggcagccctgggaaggacagtcttacccggacgccacggccgagctgcccttccctccctgctgcccccagggaaggctgctggtgtcctcagatgcgggcaggaggaacccgccagcgcctgagagcctggcccgaaccaggcctggaggtgctggggcgaagacacagaggatgtggcctccatccctggtaacagacggttaccagggcggctttgggtgaggacattgaaaaaggtcagactccctgggagcagcgccctggactccattctcatcacagaccagtggttcccaattgaagtcagttttgctcctcagggcacacttaacaacatctggagacatttttaattgtcctgaccgagaggacaatgctactggcatctagtggacagaggccagggatactgctgaacatcccgcagtgcacaggacgcctgcaacacagattatccagccccaaacgtcaatagtgccggagttatggaaccctaatgaagacaattcttgaaggcatagactgaatcttatttatctttgtttccctcatgtctcacaagcagagtatgagttcagcaaataggagttgaacagaaatcaggaggaggtgctgattgacaggaaaaaagaaagatttagtttagagctgagaattcagctggacagccataggggctctggcatggagactggaagtcagaagagaatttgcagcaagacatttagagccatttatccagccatcataattttattgagtaactattttgtgtgaggcactgtactggatgctttggcaacagagataagcaaggcaacccctgtga

SEQ ID NO: 80648 - DNA, 346 bp, Homo sapiens
agtaacttaattgataaagtcagtgaggaaggaatagaatacaacaaatggcttaaaaacagaaggccaagcgtgatggctcattcctgtaatcccagcactttgtgaggccgaggcaggtggattgcttgagctcaggagttcaagaccaacctgggcaacatggcaaaaccccatctctaccaaaaatacaaaaaattagccgggcgtggtggctcacacctgtagtcccaatttctcagaaggctgaggtgggaggatcacttgaacccaggaggaggaggtttcagtcagtagagattgaactactatactctagcctggatgacagagtaagaccttgtca

SEQ ID NO: 80649 - DNA, 811 bp, Homo sapiens
cggaccaagtgccccctgcactttcaacgccgtaggtctcccggcagccctggaaggacagtcttacccggacgccacggtggtctcccggcagccctgggaaggacagtcttacccggacgccacggtggtctcccggcagccctgggaaggacagtcttacccggacgccacggccgagctgcccttccctccctgctgcccccagggaaggctgctggtgtcctcagatgcgggcaggaggaacccgccagcgcctgagagcctggcccgaaccaggcctggaggtgctggggcgaagacacagaggatgtggcctccatccctggtaacagacggttaccagggcggctttgggtgaggacattgaaaaaggtcagactccctgggagcagcgccctggactccattctcatcacagaccagtggttcccaattgaagtcagttttgctcctcagggcacacttaacaacatctggagacatttttaattgtcctgaccgagaggacaatgctactggcatctagtggacagaggccagggatactgctgaacatcccgcagtgcacaggacgcctgcaacacagattatccagccccaaacgtcaatagtgccggagttatggaaccctaatgaagacaattcttgaaggcatagactgaatcttatttatctttgtttccctcatgtctcacaagcagagtatgagttcagcaaataggagttgaacagaaatcaggaggaggtttcagtcagtagagattgaactactatactctagcctggatgacagagtaagaccttgtca

SEQ ID NO: 80650 - DNA, 991 bp, Homo sapiens
cggaccaagtgccccctgcactttcaacgccgtaggtctcccggcagccctggaaggacagtcttacccggacgccacggtggtctcccggcagccctgggaaggacagtcttacccggacgccacggtggtctcccggcagccctgggaaggacagtcttacccggacgccacggccgagctgcccttccctccctgctgcccccagggaaggctgctggtgtcctcagatgcgggcaggaggaacccgccagcgcctgagagcctggcccgaaccaggcctggaggtgctggggcgaagacacagaggatgtggcctccatccctggtaacagacggttaccagggcggctttgggtgaggacattgaaaaaggtcagactccctgggagcagcgccctggactccattctcatcacaggtatatttgtgtggctactaagagtaagagcctgggggtgcaggagtgattccagccccctcctacaaagtcatgtgagagggatctgaagaaaatccaggggaaaatgtaccacagcgaggaaatcgccatctaaagggctgaacgctcaagaacggcgttgggtgggctccgcgttggagttgagtcccgaaggatgttctaacagcaaaggggagaaaggaagagagaagccaaggcgtgcgggcaacgtgaaccgcatgagccgaggcaaaggggcagcgtggggctggaccctggagtctgctcctgtctgaattctagtgctgtcactgactagcaaggaacttccctgtgcctcgtggctgtcacatggaaagacagcaccgccatccagcccttataccgtaagggttatatgaactagcactgtgggcattagcagagcatgctgtacactttggtatattgtgagaatgaaataaatcaacaaatgcaaagcaggttttgcataacaaagactaaacaagtgttagttagctcctttcctccttcccgcctgtgaaaatg

SEQ ID NO: 80651 - DNA, 765 bp, Homo sapiens
  misc_feature (435)..(436): n is a, c, g, or t
  misc_feature (459)..(459): n is a, c, g, or t
  misc_feature (463)..(463): n is a, c, g, or t
  misc_feature (481)..(481): n is a, c, g, or t
  misc_feature (501)..(502): n is a, c, g, or t
  misc_feature (518)..(518): n is a, c, g, or t
  misc_feature (538)..(538): n is a, c, g, or t
  misc_feature (546)..(546): n is a, c, g, or t
  misc_feature (592)..(592): n is a, c, g, or t
  misc_feature (602)..(602): n is a, c, g, or t
  misc_feature (623)..(624): n is a, c, g, or t
  misc_feature (631)..(631): n is a, c, g, or t
  misc_feature (644)..(644): n is a, c, g, or t
  misc_feature (647)..(647): n is a, c, g, or t
  misc_feature (649)..(649): n is a, c, g, or t
  misc_feature (654)..(654): n is a, c, g, or t
  misc_feature (686)..(686): n is a, c, g, or t
  misc_feature (734)..(734): n is a, c, g, or t
ctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagcatcatcttctcgcaaaaccgcagctgcacaanncagtgctagcaacagtgctgtgntagncaaaaaaacgtcacagcngtgcagcgcgcgcgagccgnnacagctgcgcccgcanacacgcacgcgcgccacaantgccaacntcacgtgcgcacacagtgcgccgcctgcgcagacgtgcagcagcantaaacacagncgcgcgcgtgcgctgcacacnnagcagcngcactgctacacncantnatacntaacagcgctcactcttcaagcgcgcacaagngcgtgccacactacacaacactgctgcctactcaacacaacacacacncagcacgacacatcgcacgctcatacctaaa

SEQ ID NO: 80652 - DNA, 366 bp, Homo sapiens
gaggatggatggaggtgaaagtaggggggtattttctaggaagtttaagggtctcagctttttcttttctctctcctcttcaggatcatcttctcgaaccccgagtgacaagcctgtagcccatgttgtaggtaagagctctgaggatgtgtcttggaacttggagggctaggatttggggattgaagcccggctgatggcaccaccagctggttatctctcagctccacgccattggccaggagggcattggcccggcggttcagccactggagctgcccctcagcttgagggtttgctggagggagggagagagggagaggagagtcagtgtggccatgtcggttcactctccacatcctggcc

SEQ ID NO: 80653 - DNA, 2282 bp, Homo sapiens
ctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagaggtgagtgcctggccagccttcatccactctcccacccaaggggaaatggagacgcaagagagggagagagatgggatgggtgaaagatgtgcgctgatagggagggatggagagaaaaaaacgtggagaaagacggggatgcagaaagagatgtggcaagagatggggaagagagagagagaaagatggagagacaggatgtctggcacatggaaggtgctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagatagggtgtctggcacacagaagacactcagggaaagagctgttgaatgcctggaaggtgaatacacagatgaatggagagagaaaaccagacacctcagggctaagagcgcaggccagacaggcagccagctgttcctcctttaagggtgactccctcgatgttaaccattctccttctccccaacagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaaaaaagt

SEQ ID NO: 80654 - DNA, 970 bp, Homo sapiens
ctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgttaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaaaaaagt

SEQ ID NO: 80655 - DNA, 1676 bp, Homo sapiens
ctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaaaaaagt

SEQ ID NO: 80656 - DNA, 1659 bp, Homo sapiens
gaggatggatggaggtgaaagtaggggggtattttctaggaagtttaagggtctcagctttttcttttctctctcctcttcaggatcatcttctcgaaccccgagtgacaagcctgtagcccatgttgtaggtaagagctctgaggatgtgtcttggaacttggagggctaggatttggggattgaagcccggctgatggtaggcagaacttggagacaatgtgagaaggactcgctgagctcaagggaagggtggaggaacagcacaggccttagtgggatactcagaacgtcatggccaggtgggatgtgggatgacagacagagaggacaggaaccggatgtggggtgggcagagctcgagggccaggatgtggagagtgaaccgacatggccacactgactctcctctccctctctccctccctccagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaaaaaagt

SEQ ID NO: 80657 - DNA, 356 bp, Homo sapiens
tttatacagtttaacaaatataatctcccttttctttccagagattacttcatttagacatcaaactatgttgttgttgtttttttcccctggggagaggggatataaataaattgacatctattcacataggtctcaatggtctaccagatccacccaggccctaatcctctttgttgtcatggaatccacctggcttaattatatttacagttttcaacgacaccacatggcatgcaggttttccctgaactctgcacatcttcccgaatcctagctataagtcacactccagctgctgtatccgtctcggattctagacggtgacaaggcactcttgcctgaaactcagcatc

SEQ ID NO: 80658 - DNA, 537 bp, Homo sapiens
acgcctcaccctgttttgcaacttcttgtttatgagcctggaagccacgaagtggtgggaaatacgagattcaaatatctggtggccgtgtgacgtgagtaaattactcgatttttctcagtttccatttcctatcaaatgggttgttctgggaattcggggaagtaacagtgccgggaaccgcgggaggaaccgccagctgcgtcctcggacgtccccaaagcccagggcggcgactggcacgactgtcaggggcgcgtctgttaagaggacagggggtcccgccccggcacagccgtctcctccaggacccctcccgccgacgccccacggaccccacgcccgagcggagaccggcgcgagtccggggtctccggtccggcagcccctccctggcccggcgccccaaagggaagcggcctgggggaggagacgtgtggaaagagcggcagaagataaagaggaagtagcggtagagaataaaaaggaactgtccgcagtgtgcccggacgcggggaggcgctggggtcaagcgag

SEQ ID NO: 80659 - DNA, 346 bp, Homo sapiens
cctgtccttgtcgtccctcattcacttaattatgatacttgcctggcatcttgcaggtttctgatgctgttaccccagtatagaccaagtgcagacagaatttcatttctgctttattaaggcacagtcttgagaaacccattggcttcacacacaattaattaatttgtggcaacaagctactatattggcttgcatgtcactttcacctctctgggcattagttttctctaatatttataaaagaaggacatgactttctaaggttccttgcagtaattatgcagttctattctaatagatgcttaagcataaaacccattttaatactgtccaaggatccagg

SEQ ID NO: 80660 - DNA, 341 bp, Homo sapiens
aacaaggatacaagttaggcttttaaaaatatatctgatttcatagatttgacttgggaacaagtatatattttacatagttataaggcaaaatatgatttaaaccatctctaaaaatccaaaggaaatggaaaaaaaatgaacttaagtgcatgtagaattggtgtcataaacacacaaagaagtgctccaagagactttaaaacacagtcattggactgtatatctctcttagtatatatcctaatgacaaaagaaactacaaaaacatcttaaaacttttttcataatcatattactggtgacagtgtggtagtaataaactgagactgttgtatgtg

SEQ ID NO: 80661 - DNA, 348 bp, Homo sapiens
ttctgcaatgtaaaagcaataccccatgaccaatcctattcctgattttcataattttaccccaaagaaaagagaggaaatcatggtaacctccaaccccaactatatatgctcataactaatagcattagagaaaatacattcagttcccagaacacagtgctaagacctgaacttgctgctgggttccatggaaaagcctagaggcctaaactttgacaaccactgccatgtgaaatgctaccccggctatagacaaaaaaactatgtctgttatatcctggaatatgtgatgctcattttacttctatattaaatttttttctccttcctcatttcaatttacca

SEQ ID NO: 80662 - DNA, 893 bp, Homo sapiens
gcattatgaatgaaaaggatttctctttttctgactcacagtgttttaaagctgaagcttcacaaaaccaaggtatttttacatgtgactttgtacccacacaaatattcctacaagggttaaatggagtactgattaagattagaaatacacgattccagttatggaaactttcctttctttttccctatatccaagcttaaaggttatagttttaaaataaacagtgagaggaacggccttcccttagtagacacagggaatgtatcacctttaaagtctgtgctgctaagattagaaataggcatggacaaatctaaacaaagtgctgctgtctgcatattgcttcagatcagctgtcgaagatttttgtttgttgcattttgtttgtgcttcaaggtccacagtccctttgagtaaccggctcctaaggccctggctgacacgctcaggttgcgaaagttggtggaaaactgaagcagtgttagaatgactgatgaggaggctgttgtgtttaagggtgaaatgatggcccacaggcatccatggacacctcctaaaggaagaaagtggctttgctctgtgaaggaggatagcagcagggcctggaaatgggagtttgcctccgcttcctcctgggaggttcctcaatcactccgtaaatacagggctgtggcgtgcaaacactaatgcaggtgtggttccatttctaccagcttagagaaggccacatgaaacaaatcagaacataaaaaaagaacaaaatgagaaaaccaaggacaaccaatcagaggtctgggactcaaaagatgtggcgtggttggatatttaaatgatgtcgcacagtgtggacagaaaaagatcacccccggggtggagaaagggggtggtca

SEQ ID NO: 80663 - DNA, 383 bp, Homo sapiens
gttatttcttgctcacataacaatttcaaggtaggcgtccctggtcagcaaacggcttgctttcacttggtagaaggacccagactctgccattcgtcagcacttcactcttgtctaaatccagtcagcagaaaggcaaggagaaagtatggagaaagcatacttgcttagcttcttagaagcttcttgcagtgttacacattacattggctcacattccagtcacagggaggcagccacttcctagaacaaacgctattctctggaggaggagccaggattttagtggacaaacaaccttctctcccacagttgatttctacttgtgaaaacctttgggacttagcttgaacatcacttgctcaaaaagcaaaaacaaacaa

SEQ ID NO: 80664 - DNA, 415 bp, Homo sapiens
tgctgtcattcatgaataactggcttggcccatgtgaaaaggacccctttattgtcagtatcactgatggcttcctataagtacatctgttaggaaaaagaactttcagtagttaatggaaattagaatgcaactgtcggccaggcacagtggctgacacctgtaatcccagcactttgggaggcccaggcaggtgaatcacgaggtcaagagattgagaccatcctggccaacatggtgaaaccttgtctctactaaaaaatacaaaattagttggcatggtgggacctgtagtcccagctactcaggaggctgagacaggggaatcacttgaacccaggaggcagaggttgcagtgagtcgagatcgtgccactgcattccagccttgcaacagggcgagataccatctcaaa

SEQ ID NO: 80665 - DNA, 421 bp, Homo sapiens
tcttctttaaaaacaaaatcttaaatttggtatttaggaaggtttatgtttctgttgtccttttgcttatactttttttaatgcccttagcgccccccccattttttatttagaatctgtattgtccatctttaatgacattctttaactttcacatgttgcttaaataccagttattgagttttcctactttccttttttcatctaccttctcttcctatttttagttgcatcattttttattcatcagaacatacagcacaaaacaaatagcattatcatataacctattattattataccctgttctcaccttaattttgatcttagatttgcaattaagtatatttaatgctaaattgctgaagtttctctagtcatttttttgtttgaataaagtttattttctagcagatttctt

SEQ ID NO: 80666 - DNA, 2216 bp, Homo sapiens
ctcctggagagccggctcggcgccgcccgcgcgcccgcgccagagcagccatgtaccggcgcagctacgtcttccagacccgcaaggagcagtacgagcacgccgacgaggcttcgcgcgccgccgagcccgagcgcccggccgacgagggctgggctggggcaacgagcctggcggcgctgcaggggctcggcgagcgcgtggccgcccacgtccagcgggcccgcgccctcgagcagcgccatgccgggctccggaggcagctggatgccttccagcgcctgggcgagctggccgggcccgaggacgccctcgcccgccaagtcgagagcaaccgccagcgcgtccgggacctggaggccgagcgcgcccggctggagcgccagggcaccgaggcgcagcgcgcgctcgacgagttccgaagcaagtatgaaaatgagtgcgaatgtcaactcctgctaaaagaaatgcttgaacggcttaacaaggaagctgatgaagccttgctgcataacctacgccttcagctggaagcccaatttctgcaagatgatatcagtgcggcaaaggacaggcacaagaagaatcttctggaagttcagacctatatcagcatcctgcagcagatcatccacaccactcctccagcatccattgtgacgagtgggatgagggaggagaagctcctgacggagcgggaggtggccgccctgcggagtcagctggaggagggccgggaggtgctctcccacctgcaggcgcagagagtggagctgcaggcacagacaacaactctggaacaagctattaaaagtgcccatgagtgttatgacgatgagattcagctttataacgagcagattgagacactgcgcaaggagattgaggagacagagcgggtcctggagaagtcttcttacgactgccggcagctggcggtcgcccagcaaaccctgaagaatgagctggaccggtatcatcgtatcatcgagattgaaggcaacaggctgacctctgccttcattgaaactcccattcccctgttcacccagagccatggagtctctctcagcactggatccggtgggaaagatcttaccagagctctgcaggatataacagcagcaaaaccaagacaaaaagccctccccaagaatgttccaaggagaaaagagattataacaaaagacaaaaccaacggagctctggaagatgcaccattaaaaggtttggaagacacaaagctggtacaggtggtacttaaagaggaaagtgaatctaagtttgaatcagaaagtaaagaagtaagtcccctgacacaagaaggggctccagaggatgtgccagatggagggcagataagcaaaggctttgggaaactatacaggaaggtcaaggagaaagtgagaagccccaaagagcctgagacccccactgagctctacaccaaagagcggcacgtgctggtcacaggggatgccaattacgtggaccctagattctatgtctcctccatcacagctaaaggtggggtggctgtttctgttgcggaagactctgtgctttatgacggccaggtggagccctctcctgagtcacccaagccccctttagagaatgggcaggtgggtctgcaggagaaagaagatggacaaccaattgaccagcagcctatagacaaggagattgagccagatggtgcagagctggaaggccctgaagagaaacgtgagggtgaggagcgggacgaagagtccaggagaccctgtgccatggtcacacccggtgcagaggaaccatctatacctgagcctccaaagcctgcggctgatcaggatggagctgaggtgcttgggactaggagcagaagcctgccagaaaaaggccctcccaaggctttggcctataagacagtggaagtggtggaatctatcgagaagatttccacggagagcattcagacatatgaagaaaccgctgtgatcgtggagaccatgattggaaagacaaagtcagacaagaagaaatcaggagagaagagctcttaaaatgcccaggcttgatgggataaaatgtatttggggccactgtaggggtaatgctttgatattttagagcaaatgataaaagggtgagggttcctgtttggattagaccatagttgacccatctggcattgccaacgaagccttcattaaaatgttttctttgcttgc

SEQ ID NO: 80667 - DNA, 2438 bp, Homo sapiens
aattttccatgctggaagtggaaggaattgcttgctcatttatattctctatcctgtggaaagccttccctcccaccccttgagccagtgagtcacttcctctctgcaaacctctaaagcctcctttctttctcagcccagacctggccctctggagagggttttggagtcctgggtaggcagggtacctcaggcagcaggcagcacaccttggatgtgagctgaatggattttcaaatttcacagaaggagcctccatgctggagaaagtatgtatgaaaatgagtgcgaatgtcaactcctgctaaaagaaatgcttgaacggcttaacaaggaagctgatgaagccttgctgcataacctacgccttcagctggaagcccaatttctgcaagatgatatcagtgcggcaaaggacaggcacaagaagaatcttctggaagttcagacctatatcagcatcctgcagcagatcatccacaccactcctccagcatccattgtgacgagtgggatgagggaggagaagctcctgacggagcgggaggtggccgccctgcggagtcagctggaggagggccgggaggtgctctcccacctgcaggcgcagagagtggagctgcaggcacagacaacaactctggaacaagctattaaaagtgcccatgagtgttatgacgatgagattcagctttataacgagcagattgagacactgcgcaaggagattgaggagacagagcgggtcctggagaagtcttcttacgactgccggcagctggcggtcgcccagcaaaccctgaagaatgagctggaccggtatcatcgtatcatcgagattgaaggcaacaggctgacctctgccttcattgaaactcccattcccctgttcacccagagccatggagtctctctcagcactggatccggtgggaaagatcttaccagagctctgcaggatataacagcagcaaaaccaagacaaaaagccctccccaagaatgttccaaggagaaaagagattataacaaaagacaaaaccaacggagctctggaagatgcaccattaaaaggtttggaagacacaaagctggtacaggtggtacttaaagaggaaagtgaatctaagtttgaatcagaaagtaaagaagtaagtcccctgacacaagaaggggctccagaggatgtgccagatggagggcagataagcaaaggctttgggaaactatacaggaaggtcaaggagaaagtgagaagccccaaagagcctgagacccccactgagctctacaccaaagagcggcacgtgctggtcacaggggatgccaattacgtggaccctagattctatgtctcctccatcacagctaaaggtggggtggctgtttctgttgcggaagactctgtgctttatgacggccaggtggagccctctcctgagtcacccaagccccctttagagaatgggcaggtgggtctgcaggagaaagaagatggacaaccaattgaccagcagcctatagacaaggagattgagccagatggtgcagagctggaaggccctgaagagaaacgtgagggtgaggagcgggacgaagagtccaggagaccctgtgccatggtcacacccggtgcagaggaaccatctatacctgagcctccaaagcctgcggctgatcaggatggagctgaggtgcttgggactaggagcagaagcctgccagaaaaaggccctcccaaggctttggcctataagacagtggaagtggtggaatctatcgagaagatttccacggagagcattcagacatatgaagaaaccgctgtgatcgtggagaccatgattggaaagacaaagtcagacaagaagaaatcaggagagaagagctcttaaaatgcccaggcttgatgggataaaatgtatttggggccactgtaggggtaatgctttgatattttagagcaaatgataaaagggtgagggttcctgtttggattagaccatagttgacccatctggcattgccaacgaagccttcattaaaatgttttctttgcttgcacatcctttgtctaattaatagggaccttgggaatgtaggtgggtcagcttcatgaggacagggatgctctgttaaatggccaccataccgtcctcatttaggaaagagacatgctcttcatcctggttcataagtctcgttagagactcagatagcatctggatttcacacagaaacatgctggttgatgacatcggctcatcttcattccatttcaagcacaagtgtgtgcttatgtggatgagtgttttgctagagatgaaattattaaaggcatctctcttaatgtggattcccccagaagctgatcccaaagcagagaatgcgaagtttcattggaagatgaatttaggatgcacaagtaggagagtggag

SEQ ID NO: 80668 - DNA, 2592 bp, Homo sapiens
ctcctggagagccggctcggcgccgcccgcgcgcccgcgccagagcagccatgtaccggcgcagctacgtcttccagacccgcaaggagcagtacgagcacgccgacgaggcttcgcgcgccgccgagcccgagcgcccggccgacgagggctgggctggggcaacgagcctggcggcgctgcaggggctcggcgagcgcgtggccgcccacgtccagcgggcccgcgccctcgagcagcgccatgccgggctccggaggcagctggatgccttccagcgcctgggcgagctggccgggcccgaggacgccctcgcccgccaagtcgagagcaaccgccagcgcgtccgggacctggaggccgagcgcgcccggctggagcgccagggcaccgaggcgcagcgcgcgctcgacgagttccgaagcaagtatgaaaatgagtgcgaatgtcaactcctgctaaaagaaatgcttgaacggcttaacaaggaagctgatgaagccttgctgcataacctacgccttcagctggaagcccaatttctgcaagatgatatcagtgcggcaaaggacaggcacaagaagaatcttctggaagttcagacctatatcagcatcctgcagcagatcatccacaccactcctccagcatccattgtgacgagtgggatgagggaggagaagctcctgacggagcgggaggtggccgccctgcggagtcagctggaggagggccgggaggtgctctcccacctgcaggcgcagagagtggagctgcaggcacagacaacaactctggaacaagctattaaaagtgcccatgagtgttatgacgatgagattcagctttataacgagcagattgagacactgcgcaaggagattgaggagacagagcgggtcctggagaagtcttcttacgactgccggcagctggcggtcgcccagcaaaccctgaagaatgagctggaccggtatcatcgtatcatcgagattgaaggcaacaggctgacctctgccttcattgaaactcccattcccctgttcacccagagccatggagtctctctcagcactggatccggtgggaaagatcttaccagagctctgcaggatataacagcagcaaaaccaagacaaaaagccctccccaagaatgttccaaggagaaaagagattataacaaaagacaaaaccaacggagctctggaagatgcaccattaaaaggtttggaagacacaaagctggtacaggtggtacttaaagaggaaagtgaatctaagtttgaatcagaaagtaaagaagtaagtcccctgacacaagaaggggctccagaggatgtgccagatggagggcagataagcaaaggctttgggaaactatacaggaaggtcaaggagaaagtgagaagccccaaagagcctgagacccccactgagctctacaccaaagagcggcacgtgctggtcacaggggatgccaattacgtggaccctagattctatgtctcctccatcacagctaaaggtggggtggctgtttctgttgcggaagactctgtgctttatgacggccaggtggagccctctcctgagtcacccaagccccctttagagaatgggcaggtgggtctgcaggagaaagaagatggacaaccaattgaccagcagcctatagacaaggagattgagccagatggtgcagagctggaaggccctgaagagaaacgtgagggtgaggagcgggacgaagagtccaggagaccctgtgccatggtcacacccggtgcagaggaaccatctatacctgagcctccaaagcctgcggctgatcaggatggagctgaggtgcttgggactaggagcagaagcctgccagaaaaaggccctcccaaggctttggcctataagacagtggaagtggtggaatctatcgagaagatttccacggagagcattcagacatatgaagaaaccgctgtgatcgtggagaccatgattggaaagacaaagtcagacaagaagaaatcaggagagaagagctcttaaaatgcccaggcttgatgggataaaatgtatttggggccactgtaggggtaatgctttgatattttagagcaaatgataaaagggtgagggttcctgtttggattagaccatagttgacccatctggcattgccaacgaagccttcattaaaatgttttctttgcttgcacatcctttgtctaattaatagggaccttgggaatgtaggtgggtcagcttcatgaggacagggatgctctgttaaatggccaccataccgtcctcatttaggaaagagacatgctcttcatcctggttcataagtctcgttagagactcagatagcatctggatttcacacagaaacatgctggttgatgacatcggctcatcttcattccatttcaagcacaagtgtgtgcttatgtggatgagtgttttgctagagatgaaattattaaaggcatctctcttaatgtggattcccccagaagctgatcccaaagcagagaatgcgaagtttcattggaagatgaatttaggatgcacaagtaggagagtggag

SEQ ID NO: 80669 - DNA, 1781 bp, Homo sapiens
ctcctggagagccggctcggcgccgcccgcgcgcccgcgccagagcagccatgtaccggcgcagctacgtcttccagacccgcaaggagcagtacgagcacgccgacgaggcttcgcgcgccgccgagcccgagcgcccggccgacgagggctgggctggggcaacgagcctggcggcgctgcaggggctcggcgagcgcgtggccgcccacgtccagcgggcccgcgccctcgagcagcgccatgccgggctccggaggcagctggatgccttccagcgcctgggcgagctggccgggcccgaggacgccctcgcccgccaagtcgagagcaaccgccagcgcgtccgggacctggaggccgagcgcgcccggctggagcgccagggcaccgaggcgcagcgcgcgctcgacgagttccgaagcaagtatgaaaatgagtgcgaatgtcaactcctgctaaaagaaatgcttgaacggcttaacaaggaagctgatgaagccttgctgcataacctacgccttcagctggaagcccaatttctgcaagatgatatcagtgcggcaaaggacaggcacaagaagaatcttctggaagttcagacctatatcagcatcctgcagcagatcatccacaccactcctccagcatccattgtgacgagtgggatgagggaggagaagctcctgacggagcgggaggtggccgccctgcggagtcagctggaggagggccgggaggtgctctcccacctgcaggcgcagagagtggagctgcaggcacagacaacaactctggaacaagctattaaaagtgcccatgagtgttatgacgatgagattcagctttataacgagcagattgagacactgcgcaaggagattgaggagacagagcgggtcctggagaagtcttcttacgactgccggcagctggcggtcgcccagcaaaccctgaagaatgagctggaccggtatcatcgtatcatcgagattgaaggcaacaggctgacctctgccttcattgaaactcccattcccctgttcacccagagccatggagtctctctcagcactggatccggtgggaaagatcttaccagagctctgcaggatataacagcagcaaaaccaagacaaaaagccctccccaagaatgttccaaggagaaaagagattataacaaaagacaaaaccaacggagctctggaagatgcacaaccaattgaccagcagcctatagacaaggagattgagccagatggtgcagagctggaaggccctgaagagaaacgtgagggtgaggagcgggacgaagagtccaggagaccctgtgccatggtcacacccggtgcagaggaaccatctatacctgagcctccaaagcctgcggctgatcaggatggagctgaggtgcttgggactaggagcagaagcctgccagaaaaaggccctcccaaggctttggcctataagacagtggaagtggtggaatctatcgagaagatttccacggagagcattcagacatatgaagaaaccgctgtgatcgtggagaccatgattggaaagacaaagtcagacaagaagaaatcaggagagaagagctcttaaaatgcccaggcttgatgggataaaatgtatttggggccactgtaggggtaatgctttgatattttagagcaaatgataaaagggtgagggttcctgtttggattagaccatagttgacccatctggcattgccaacgaagccttcattaaaatgttttctttgcttgc

SEQ ID NO: 80670 - DNA, 2425 bp, Homo sapiens
  misc_feature (416)..(416): n is a, c, g, or t
gctgtgggtactaaaaccacttttaagaaccactgacctgggtatagaagaaactatttgtaaccaggctttttcttcttttggtccttaggtaaataaaactcaagttgatgaggtatgattttaccttaaatcaaaaccatttttggtaaagtactaccttagctctattgtaaggtaagtgtaaattagatttgctttgacttagttgctacagaccacaattataggacaactaactgaggaatttattcacttgtcccttcttttgaacctcactgtgctctggcttgccaggaggtgcaagtgtcgtccccgctttgtacttggcgctccaggcctgggtcacttcacttgagttatcagaggcaaccgtctagtttgacaaactaccggaggctcctgatagagaaggncgtgggcgccaatctaggagacaaagcctgagccgctgcggtgagccaacccaaacccatccgcgggtcttctttccagagacattttcggagccgagggcgcctctgcgagagcgctgcgaacaggttccgacgcgccggagatcgcgcgacgaatctgcgcctcgaaccctcgctttccagcagtcgccggattgctgctccacagggagccaacgcgcttgaggaccagcccagccggggctctctggatcagtaggctgtgcaggctgcgagctcgttgacgcatctcagcccactcccttgtcctcccgcctggcgaagatgtccgccaagcctgaagtcagcttagtgcgcgaggcttctcggcagatcgtggccggtggttctgcaggtcttgtagaaatttgcctgatgcaccccctagatgtggtgaaaaccaggtttcagattcagagatgtgcaaccgatccaaacagttataaaagcttggtagacagctttcgaatgattttccaaatggaagggttatttggtttttacaagggaattctgccacctatcttggctgaaaccccaaaaagagcagtgaagtttttcacctttgagcagtacaagaaattgctgggatatgtgtcactgtcaccagcattgacattcgccattgctggattgggatctggactaacagaagccattgtagttaacccttttgaggtagtaaaagttggcttgcaagcaaatcggaacacatttgcagagcaaccatccactgtgggttatgcaagacaaatcattaagaaggaaggctggggactccagggcctcaacaaaggattaactgcaactttgggacgacatggagttttcaacatggtttattttggcttctactacaatgtcaaaaacatgattcctgtcaataaggatccaatcttggagttttggagaaaatttgggattggtcttctctcggggacaatagcctcagtcattaacatcccttttgatgttgccaaaagtaggattcaagggcctcaaccagttcctggagagatcaagtacagaacctgttttaaaacaatggcaacagtctatcaggaagaagggattttagctttgtacaaaggcctgcttcccaagattatgagacttggaccaggtggtgcagtgatgctgctggtttatgaatacacctattcatggcttcaagagaactggtgattgcctatgaagtgtttttcccccttgagataatggatatttgctatgcagcaccatgaagaagagagactatcgatcggccaggtgtataattatgaaggagaaaactgttcaagaacaaaatctattttaatactttaaaaaatgtctataggcaacttgagattatagttttggctgtataaataaaactgtgagaagaaaaaaataatatgaaacaatgaggtatttaaagtgaatatagaaaaatagcatagaaatcatatatttatttcataaaataaatagaaactttgtctcctgtgttcctcttcaatgcttcacaatgaaaattcattgtattgatcagcatttttcctaagaggtctagaaatgcttaaactattgaaaataaatcaaattattcaaagactggattaaaaaaaagttaagccaaaatttaagcagtttttataatgaattaaattattccataaataatatttaaagagcacaagaaaaattttttaaagtgcactaaaatgaccttttaagaatgtttaattttatgaatactatgttaaaatgtaaatctgttggttttttttagtaactatgcacatatcagctctattttcctacatctactttatatctcatattgctgtaagataataaataggtattttaaaacattgtttaaaacagaatgttaaaacactgttgtttaagcatgtttaaatcaaggtattccaaatctcttctaacacaagtaggaaacatgaaataaaatttactttcctcca

SEQ ID NO: 80671 - DNA, 1065 bp, Homo sapiens
  misc_feature (416)..(416): n is a, c, g, or t
gctgtgggtactaaaaccacttttaagaaccactgacctgggtatagaagaaactatttgtaaccaggctttttcttcttttggtccttaggtaaataaaactcaagttgatgaggtatgattttaccttaaatcaaaaccatttttggtaaagtactaccttagctctattgtaaggtaagtgtaaattagatttgctttgacttagttgctacagaccacaattataggacaactaactgaggaatttattcacttgtcccttcttttgaacctcactgtgctctggcttgccaggaggtgcaagtgtcgtccccgctttgtacttggcgctccaggcctgggtcacttcacttgagttatcagaggcaaccgtctagtttgacaaactaccggaggctcctgatagagaaggncgtgggcgccaatctaggagacaaagcctgagccgctgcggtgagccaacccaaacccatccgcgggtcttctttccagagacattttcggagccgagggcgcctctgcgagagcgctgcgaacaggttccgacgcgccggagatcgcgcgacgaatctgcgcctcgaaccctcgctttccagcagtcgccggattgctgctccacagggagccaacgcgcttgaggaccagcccagccggggctctctggatcagtaggctgtgcaggctgcgagctcgttgacgcatctcagcccactcccttgtcctcccgcctggcgaagatgtccgccaagcctgaagtcagcttagtgcgcgaggcttctcggcagatcgtggccggtggttctgcaggtaaggacagcccgccctgccccgccggaggctagtcgctttccccaccgcgtgtcctgaaaccgttgcccagacaggtctccttactgaagttctgccctcttcctcaaaattcagcgctcccggagcagtgcttgagcccctagaggcgcgagagcagaggaggccgggagttgattgcgagtagtgggtgccccaagtaaagttgcctcggcgtccgcgccggccgctctcgggttcccggcattgtccgtt

SEQ ID NO: 80672 - DNA, 3123 bp, Homo sapiens
tatatatgcatatgggcgttcgtacttggccagcgccatcttgtctgtgccctacgtgtgcacatgaactggatcctgatcgagaatatggctccaccctagtcagaacttgccatgtgcccaggggtcttgtagaaatttgtgtgatgaatcccagatagatgtgtggagaatacactagagtgattcgtgattaaacgagaggtgaatgcttggcacgtatttatggttgagacccgaaaggagcagtgaagacattcgccattgctggattgggatctggactaacagaagccattgtagttaacccttttgaggtagtaaaagttggcttgcaagcaaatcggaacacatttgcagagcaaccatccactgtgggttatgcaagacaaatcattaagaaggaaggctggggactccagggcctcaacaaaggattaactgcaactttgggacgacatggagttttcaacatggtttattttggcttctactacaatgtcaaaaacatgattcctgtcaataaggatccaatcttggagttttggagaaaatttgggattggtcttctctcggggacaatagcctcagtcattaacatcccttttgatgttgccaaaagtaggattcaagggcctcaaccagttcctggagagatcaagtacagaacctgttttaaaacaatggcaacagtctatcaggaagaagggattttagctttgtacaaaggcctgcttcccaagattatgagacttggaccaggtggtgcagtgatgctgctggtttatgaatacacctattcatggcttcaagagaactggtgattgcctatgaagtgtttttcccccttgagataatggatatttgctatgcagcaccatgaagaagagagactatcgatcggccaggtgtataattatgaaggagaaaactgttcaagaacaaaatctattttaatactttaaaaaatgtctataggcaacttgagattatagttttggctgtataaataaaactgtgagaagaaaaaaataatatgaaacaatgaggtatttaaagtgaatatagaaaaatagcatagaaatcatatatttatttcataaaataaatagaaactttgtctcctgtgttcctcttcaatgcttcacaatgaaaattcattgtattgatcagcatttttcctaagaggtctagaaatgcttaaactattgaaaataaatcaaattattcaaagactggattaaaaaaaagttaagccaaaatttaagcagtttttataatgaattaaattattccataaataatatttaaagagcacaagaaaaattttttaaagtgcactaaaatgaccttttaagaatgtttaattttatgaatactatgttaaaatgtaaatctgttggttttttttagtaactatgcacatatcagctctattttcctacatctactttatatctcatattgctgtaagataataaataggtattttaaaacattgtttaaaacagaatgttaaaacactgttgtttaagcatgtttaaatcaaggtattccaaatctcttctaacacaagtaggaaacatgaaataaaatttactttcctccacatagttctctttgaagataagttttgttgatgagatattgtcatgttaaatcacaaattggaaacacctttggacccatttgtcagccatcagtatttgcatccaaatacctttattcagcatgcctacctgtgccatttttaggaagaatgtatagaacagaactgcattttcaggttattagttttaaacgacaacttcaggtgggaagtcagctgtctgcagtattaaaatatgtatgatgaaggggaaatgttctgaaaaagaaatacacttagcatttctaaggattactatactaacatgtatcaacaaaaatatctccttggtcttgatgtaaccaaacttgattttatatctgcatccagagatgatgctgattcagtaaagtcaacaagaataactgaaagtccatatgacacctgtcctaagttactaccgtgggctatttctactacggggctatttcactaaagcattttgaaaataaaaagtaaaagataacatggtaattattactttttattaatttagagcatttgaagtataaaaataaaaggcttttgacatactgtatatacatacatagccttctgttgtacatcctttccaacgtgttttttaaaatttatatttcagtccaatattcaataaaagggtcattaaaaacaaaacaaaattgtgaaaaaaaagaaataagaatgtgtctctgttgcacaactgcattctatccttgcaggtaatattcttacatccaatgagagcgctgcctgcatagaggtcatgaaattgaacctttaacctctccatgtggatcagatagaaaaggatttctgaagagtgcatttgccagtttaaaagcaacacttttaccatctatgagatagaggaaatatgtcaacattaaccaataataatctttaaaagttaaccctttaatccatcctattttccttctcgtattttaaaaagtggctttaaatcataattttctttgaatagcaaattgtatctgatatcttttaaaaattactccatgtgaattcactgttaagacctagagggagaaaaggaaacttcaataccattaatattagattttttaaaatacaagaaccagaaaaaaattataaatagcacaataacaagagatttcttaatttagataaagaaaataacattatttgcatttccacacaagcaagtaatattttttaaagccccctaacagccacctaaaaacatttgataaagaatagttctgtaccttacatcagtttttcagatgacaggagagtccctgtatggtatggttttaaagaagtctccaccaaaatattggattggatctttgttccattcagtttatagtctattttctcaccagactgggaactccagatgtcaatggaagttttacaagatcaaaggaagactatggccctgagagttcatctgctccttctgcttattcttctcctgaagttataatcctctatttgtagcactgaat

SEQ ID NO: 80673 - DNA, 3939 bp, Homo sapiens
  misc_feature (416)..(416): n is a, c, g, or t
gctgtgggtactaaaaccacttttaagaaccactgacctgggtatagaagaaactatttgtaaccaggctttttcttcttttggtccttaggtaaataaaactcaagttgatgaggtatgattttaccttaaatcaaaaccatttttggtaaagtactaccttagctctattgtaaggtaagtgtaaattagatttgctttgacttagttgctacagaccacaattataggacaactaactgaggaatttattcacttgtcccttcttttgaacctcactgtgctctggcttgccaggaggtgcaagtgtcgtccccgctttgtacttggcgctccaggcctgggtcacttcacttgagttatcagaggcaaccgtctagtttgacaaactaccggaggctcctgatagagaaggncgtgggcgccaatctaggagacaaagcctgagccgctgcggtgagccaacccaaacccatccgcgggtcttctttccagagacattttcggagccgagggcgcctctgcgagagcgctgcgaacaggttccgacgcgccggagatcgcgcgacgaatctgcgcctcgaaccctcgctttccagcagtcgccggattgctgctccacagggagccaacgcgcttgaggaccagcccagccggggctctctggatcagtaggctgtgcaggctgcgagctcgttgacgcatctcagcccactcccttgtcctcccgcctggcgaagatgtccgccaagcctgaagtcagcttagtgcgcgaggcttctcggcagatcgtggccggtggttctgcaggtcttgtagaaatttgcctgatgcaccccctagatgtggtgaaaaccaggtttcagattcagagatgtgcaaccgatccaaacagttataaaagcttggtagacagctttcgaatgattttccaaatggaagggttatttggtttttacaagggaattctgccacctatcttggctgaaaccccaaaaagagcagtgaagtttttcacctttgagcagtacaagaaattgctgggatatgtgtcactgtcaccagcattgacattcgccattgctggattgggatctggactaacagaagccattgtagttaacccttttgaggtagtaaaagttggcttgcaagcaaatcggaacacatttgcagagcaaccatccactgtgggttatgcaagacaaatcattaagaaggaaggctggggactccagggcctcaacaaaggattaactgcaactttgggacgacatggagttttcaacatggtttattttggcttctactacaatgtcaaaaacatgattcctgtcaataaggatccaatcttggagttttggagaaaatttgggattggtcttctctcggggacaatagcctcagtcattaacatcccttttgatgttgccaaaagtaggattcaagggcctcaaccagttcctggagagatcaagtacagaacctgttttaaaacaatggcaacagtctatcaggaagaagggattttagctttgtacaaaggcctgcttcccaagattatgagacttggaccaggtggtgcagtgatgctgctggtttatgaatacacctattcatggcttcaagagaactggtgattgcctatgaagtgtttttcccccttgagataatggatatttgctatgcagcaccatgaagaagagagactatcgatcggccaggtgtataattatgaaggagaaaactgttcaagaacaaaatctattttaatactttaaaaaatgtctataggcaacttgagattatagttttggctgtataaataaaactgtgagaagaaaaaaataatatgaaacaatgaggtatttaaagtgaatatagaaaaatagcatagaaatcatatatttatttcataaaataaatagaaactttgtctcctgtgttcctcttcaatgcttcacaatgaaaattcattgtattgatcagcatttttcctaagaggtctagaaatgcttaaactattgaaaataaatcaaattattcaaagactggattaaaaaaaagttaagccaaaatttaagcagtttttataatgaattaaattattccataaataatatttaaagagcacaagaaaaattttttaaagtgcactaaaatgaccttttaagaatgtttaattttatgaatactatgttaaaatgtaaatctgttggttttttttagtaactatgcacatatcagctctattttcctacatctactttatatctcatattgctgtaagataataaataggtattttaaaacattgtttaaaacagaatgttaaaacactgttgtttaagcatgtttaaatcaaggtattccaaatctcttctaacacaagtaggaaacatgaaataaaatttactttcctccacatagttctctttgaagataagttttgttgatgagatattgtcatgttaaatcacaaattggaaacacctttggacccatttgtcagccatcagtatttgcatccaaatacctttattcagcatgcctacctgtgccatttttaggaagaatgtatagaacagaactgcattttcaggttattagttttaaacgacaacttcaggtgggaagtcagctgtctgcagtattaaaatatgtatgatgaaggggaaatgttctgaaaaagaaatacacttagcatttctaaggattactatactaacatgtatcaacaaaaatatctccttggtcttgatgtaaccaaacttgattttatatctgcatccagagatgatgctgattcagtaaagtcaacaagaataactgaaagtccatatgacacctgtcctaagttactaccgtgggctatttctactacggggctatttcactaaagcattttgaaaataaaaagtaaaagataacatggtaattattactttttattaatttagagcatttgaagtataaaaataaaaggcttttgacatactgtatatacatacatagccttctgttgtacatcctttccaacgtgttttttaaaatttatatttcagtccaatattcaataaaagggtcattaaaaacaaaacaaaattgtgaaaaaaaagaaataagaatgtgtctctgttgcacaactgcattctatccttgcaggtaatattcttacatccaatgagagcgctgcctgcatagaggtcatgaaattgaacctttaacctctccatgtggatcagatagaaaaggatttctgaagagtgcatttgccagtttaaaagcaacacttttaccatctatgagatagaggaaatatgtcaacattaaccaataataatctttaaaagttaaccctttaatccatcctattttccttctcgtattttaaaaagtggctttaaatcataattttctttgaatagcaaattgtatctgatatcttttaaaaattactccatgtgaattcactgttaagacctagagggagaaaaggaaacttcaataccattaatattagattttttaaaatacaagaaccagaaaaaaattataaatagcacaataacaagagatttcttaatttagataaagaaaataacattatttgcatttccacacaagcaagtaatattttttaaagccccctaacagccacctaaaaacatttgataaagaatagttctgtaccttacatcagtttttcagatgacaggagagtccctgtatggtatggttttaaagaagtctccaccaaaatattggattggatctttgttccattcagtttatagtctattttctcaccagactgggaactccagatgtcaatggaagttttacaagatcaaaggaagactatggccctgagagttcatctgctccttctgcttattcttctcctgaagttataatcctctatttgtagcactgaat

SEQ ID NO: 80674 - DNA, 1443 bp, Homo sapiens
ctgttcaggctgggatgagccacagcacgcggcaacgttgccaggatacaaacaccaccagggaaagaggcctctgcaactgtacgtgcgttaattcaggcaccatttatcaccaatacaagactgagaaacacaactgcggggaatatcctggtgatgctaagggcagcgacagttctcagtggattctgctggagtgtttcttattttttttttcagaggcaggtcttgctctgttgcctaggctgcacttgaacttccgggctcagctgaacctcccaagtagcagggactacaggtgcgtgccactgcacccggctctgtgtattgtgtattgttaattccattgacttgtatgacaccgtttagaccagcccacttttccttttaaaagagaaactggttccctctcttttgaagctctatcaagatctgcttattttggtatgtgaagaaaagttaccttcccttgtccagaagccctgctctggggaagggaggataaagtcatggatgagggtagcactgcagaggctgagaaatttggggaaaattcccactcacgtaagctgacactccgcaggtgtacacttgatgctatgggtatactgtcctatctaaaaataagtattatttagcataggtaagcacagaatttactagaaccaacaaggagtactcaattaactaaaaggcagagggtacgcaggtgtctagcatggccgggtggctgtggcagtgggaaccaggtcccttctctagtttctgtgcctctgttaaggttggagcacctctcattccaccctaacagcaaggtccaaactgcccatgaggaaccctttccatgaattaaaggccaaccttcctcgagtgcccacaaatcactgaacctcgctcagaccttcccctctactggggattcgactcggtttcactgggatttcacctctaagaaactgaagtcatcaaccaactgggcctctggagaaaaacaaaaagcctataaaccaccatcccccagacacatcacatcctcatacccacacctaccatgcaaccacagggacacacatacctccaaactcctctacattcaggaggccacaaatccaggcagtaacaagcctccaaactcactcagatcagaggaaaagaacattttaaaaagtaagaacacagccaggcacagtggttcacacctgtaattccagcactttggaaggccaaggcgggcggatcatctgaggtcaggagttccagaccagcctggccaacatagcaaaaccccatctctcctaaaaatacaaaaattagccagatgtgttggcaagcacctgtattcccagctactcaggaggctgaggtgggagaatggcttgaacctgggaggcgaaggttgcaatgagcagagattgtgctgctgcactccagcctgggcaacag

SEQ ID NO: 80675 - DNA, 591 bp, Homo sapiens
gttcgacctaacaacgagggtccaatcgggcctcggggttcctgggacagtactagagtgccagcctgctggagtgctctcaatatgttgaccagtgccaggacggtcccctctagtgggaaagtatcagcgacaaacgggaattcagccagttcatatgcagtgttataaagctgtgggcctctggagaaaaacaaaaagcctataaaccaccatcccccagacacatcacatcctcatacccacacctaccatgcaaccacagggacacacatacctccaaactcctctacattcaggaggccacaaaaaaaagtaagaacacagccaggcacagtggttcacacctgtaattccagcactttggaaggccaaggcgggcggatcatctgaggtcaggagttccagaccagcctggccaacatagcaaaaccccatctctcctaaaaatacaaaaattagccagatgtgttggcaagcacctgtattcccagctactcaggaggctgaggtgggagaatggcttgaacctgggaggcgaaggttgcaatgagcagagattgtgctgctgcactccagcctgggcaacag

SEQ ID NO: 80676 - DNA, 1389 bp, Homo sapiens
ctgttcaggctgggatgagccacagcacgcggcaacgttgccaggatacaaacaccaccagggaaagaggcctctgcaactgtacgtgcgttaattcaggcaccatttatcaccaatacaagactgagaaacacaactgcggggaatatcctggtgatgctaagggcagcgacagttctcagtggattctgctggagtgtttcttattttttttttcagaggcaggtcttgctctgttgcctaggctgcacttgaacttccgggctcagctgaacctcccaagtagcagggactacaggtgcgtgccactgcacccggctctgtgtattgtgtattgttaattccattgacttgtatgacaccgtttagaccagcccacttttccttttaaaagagaaactggttccctctcttttgaagctctatcaagatctgcttattttggtatgtgaagaaaagttaccttcccttgtccagaagccctgctctggggaagggaggataaagtcatggatgagggtagcactgcagaggctgagaaatttggggaaaattcccactcacgtaagctgacactccgcaggtgtacacttgatgctatgggtatactgtcctatctaaaaataagtattatttagcataggtaagcacagaatttactagaaccaacaaggagtactcaattaactaaaaggcagagggtacgcaggtgtctagcatggccgggtggctgtggcagtgggaaccaggtcccttctctagtttctgtgcctctgttaaggttggagcacctctcattccaccctaacagcaaggtccaaactgcccatgaggaaccctttccatgaattaaaggccaaccttcctcgagtgcccacaaatcactgaacctcgctcagaccttcccctctactggggattcgactcggtttcactgggatttcacctctaagaaactgaagtcatcaaccaactgggcctctggagaaaaacaaaaagcctataaaccaccatcccccagacacatcacatcctcatacccacacctaccatgcaaccacagggacacacatacctccaaactcctctacattcaggaggccacaaaaaaaagtaagaacacagccaggcacagtggttcacacctgtaattccagcactttggaaggccaaggcgggcggatcatctgaggtcaggagttccagaccagcctggccaacatagcaaaaccccatctctcctaaaaatacaaaaattagccagatgtgttggcaagcacctgtattcccagctactcaggaggctgaggtgggagaatggcttgaacctgggaggcgaaggttgcaatgagcagagattgtgctgctgcactccagcctgggcaacag

SEQ ID NO: 80677 - DNA, 669 bp, Homo sapiens
ctcatagaatcctcacaactgctagggaagtatcatcacctctactttattgaatgagaaaaatgagctctgggaggttaaataactaacccaggctgatgggtggtgaggctgaactggctcttaaccagtagctttcctgtagtgtcccacaaggaaggagcacactgcatattaaaattattagataacaacattagttttatgatttactaaactcttctcttcttgactctttgacgaaggtaaagtagatagctttcctgaatttttttttttaataaaataagacaaatttgtgagatcttaatacttgtctcttgggagagaatgagactaaagatcttaaatattccttggccacatcattcattatctgatgctatttataaaagcatagaacaatcagacaagaatacctataaaattaaaaaaaaaaaagaaagaaaaacatagaacaagaagtttctaatctgcagaactgatgtggctatcacagggccagctgaagatcttaggagtgttagcaaacctagatgatggtttgtttaaccctgggtttggggtataccaattgcttactaagattaatatttcattctttacctttcaaccaaattaggctttctttgttttcatttgttgctacttgtgcctaggctcacattc

SEQ ID NO: 80678 - DNA, 454 bp, Homo sapiens
gaattcttctttttcatggagggggtcagtatataacattctatatacttaacttttgcatcaggtaaaacacacccatctccccgccattcccactccccatcttccttcccgtctctctccacccatattctaccattatctgttctctctttacccatcatccccttccaaaagacatttaatttctcaagatgtttccataggccaagaaagctttctctagcctcatgacattctgatttcactcttcgtagaacattcattgtgctcacctccgagcactgggctgggagtcgggagtgcactgccttccccatctttgcgtgtagggactatctagagcaggggtgtccagtcgtttggcttccctgggccacactggaagaagaattgtcttgggccacacataaaatacactaacattaacgatagctgatgagcaaaaaaaaaa

SEQ ID NO: 80679 - DNA, 672 bp, Homo sapiens
cagagattaaagagctgaggtggtgagtggttgtgatgtaaatgccatcattttctcaatactggtggccagcgttagagggaaagaggctgaaggcctgaccttgctgatgtccagccttctctgtcatggctctgctggtctgtgtcctccaccctgtggccacaccccaccttttcaagagcccttctttgaaagtcaggagacctaaggttgaggactggtcctacctttgtctttgaatagtttttagcctgaagcgtcttatcccctggtgggtgcttggatatttgtgggggacaattttggttgtcacaattatggttattatattatttttgagttttgttttatttgaagataataatgatggcattataaatattaattataaaacgagggtgctgggtgggcgtggcgactgacgcctataatcccagtgtggatcacttgaagttaggagtttaagactagcctggccaacacggtgaaaccctgtctctactaaaaatacaaaaattagctgggtgtggtggtgggtgcctgtaatcccagctactcaggaggctgagacaggagaattgcttgcccaggaggtggagtttgcagtgagctgagatcatgcccctgcactccagcctgggcgacacagcaagacagtatctcaaaaaa

SEQ ID NO: 80680 - DNA, 663 bp, Homo sapiens
cagggagccggtggcgccctcgctcgagaaggagtcgggaagaggagagtggctttcgggaagaggagagtggctttcgggaagcatctcctctgaggaagaggcggcggcggcggcggcatttacggagagaaaaaattctctgaaaattccatttgaaacactgaaaaaacaccatctattttcttttggaaaatggcacatggatggaactggaagccattatcctcagcaaactaatacaggaacaaaaaaaccaaacaccactttttctcacttacaaatgggagctgaacaatgagaacgcatggacacagagtgcatagctacacatggaacttcaaacaagagaaccaaactgagctaaattagagttcaaccctttctgctggctctcctggtcaatatcagaggttcccagaccacgttaccacccataatctattggcatgttacacagggctataagtagcacggcaaacctcatttctgcttacacattactcagttacctttgtcattatcagctattttactaaatgttcaagtacgaatatttgcttaattttataaaatgtttgtaaaatatctaccccgataatcacgtgttttaacatgtgtatggaagtaataaaatttatggatttcctaatgttgaaccaa

SEQ ID NO: 80681 - DNA, 425 bp, Homo sapiens
aacttgcggctctggaacagatgcactgagggccagagggtcagggccatcccctgtggctggggctgccgggagggtgagccccacctcggaggtgtgcaggctggagcagcatgctggagctgagattctgtgggtgagagagtgggagagtgtctgtgggctgagcactggtcctttctgactcacagctctggggcccattccgggacaggcttgaagaagtctcggccattgcctgccctgctgagcacgaggggaggccagaaccgtgtgcagtggccctgcccttctgcttgagctcttcctgcagctctggggaccctcttagtcccgactgcctgtctccccagcctatctgtcccggggcctgagtccctctgctgtgcccgctgcaggtccccaataaagcctgtgccctggca

SEQ ID NO: 80682 - DNA, 442 bp, Homo sapiens
agaaactctcaactgtgacagtaaacatctgagtgatttttagaaccattttaatatctctgctctagaatcgagaatgccctgttagttctgatttttaatatacaaatttgaagccactagttaggcagtaaaatatgtattagaacataactatagatttttacccaatagatcaattagtatgaaatttaggatgatatataagtacaacagaatttattcctttgaggtatgtattttcaaagtgtaatttgtgtaattaagtatgtttattcttcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcgaagcttgcagtgagccgagatcgcg

SEQ ID NO: 80683 - DNA, 279 bp, Homo sapiens
ttctgtttttttccttgcttgtatgtaaatctcctgatttttattacattccagacattacatgtaagaagacagcagatgcagaagcaaaaaatatttttgcctggaaataataatgattcttttagtatcaggccattggtgttgggaaatggggttgagtagggaagttgagtcaatctagatagaaattgatttgaatttgtgtttcattgttgcaaactgaccacaaagttgaagtctctcccttagtgggctacctttaacatgcgcttgcaa

SEQ ID NO: 80684 - DNA, 375 bp, Homo sapiens
aacgtttgaacctgggaggtagaggttgcagtagccaagatcacgccactgcattccagcctgggcaacggagtgagactctgtctctaaataaataaataaataaatataaataaataaaacaaaaaattaaaagttgccctaaatattaaagtttaagccccaaagtgctagttttaggagacatcaacattatggatgctgtttactctgagggtaagcccatcatacatcttttacattttaaaattaaatatgatgctgaaatgttgaggttgaaatatactgatgtctccaacttactttgaaatgcatgaaaaaataaaatgaattcatggataggtagatggtaggtatgtgagaaagcagataccg

SEQ ID NO: 80685 - DNA, 896 bp, Homo sapiens
ggaaacattcttaaaggggcaaggcttgtgtctttcactttaaatttttgaaaaaaaaaaatttttttttgagatggagtcttgctctgtcgcccaggctggagtgcagtggcacgatctcagctcactgcaagctccacctcccgggttcacgcaattcctacctcagcctcccgagtggctgggactacaggcgcccgctaccacgcctggctaatttttttgtatttttagtagagacggggttccaccgcgttagccaggatggtctcgatctcgtgacctcgtgatccgcctgcctcggcctcccacagtgctgggattacaggcgtcagccaccgcgcccggccttgaaaaatgttttaatccacctttttacttggcagaattggtgttttaggccacaaatttcctttcaacaagcatattttcttgctaattattaactttctttattgcttattaaccttaaagtccctctagtgaaaacactcttgggtaaaattgcctggttgaaaatctttgaactccatctatttttttgtcgttgctggaataatgaaaggttaagaatttctaaactggccaggcacagtggctcactcctgtgattccagcgctttgggaggctgaagcagaaggatagcttgagcccaggagttccaggctgcagtgagctatgatcacaccactgccctttagccagggtgacagactgaaaccctttatctaaacaaacaaacaaacaaacaaacaaacaaacaaaaaaccacacagaatttctaaaccaacagatgttttcggccacacataaaaaccaatgaaataattgactttatcacagggttgctgcattaattcttggctgtgtcagtgccatttttcatttttgtcac

SEQ ID NO: 80686 - DNA, 498 bp, Homo sapiens
ttgggctagtccttggtttccacatttccctgggtcattgtttttgtttctcactagatgccagcttgtttgctttgaggaaaacatatggggggtggtggctttaacgctggcttgaggacagggcggcaggaggagtaggcagcctcggctcacgggccctgcccaggagggctgctctcagtgttccccaaagaaccaaacagccgggtcctgcttccttaggggtggtgtcatgtcagcctgtgcatcacggtggcacagcagaggtcccggttgccagcgtggtccctcccagcctcacttctgtgaccttctgcccacctgagcctgagttgaaagtcagtcctccaggttcctggtttggtgttcaaggctcatcaccagagggagatctaggagtttatggggttctagatgggcccagggaggaggacccaggctgagccgtgagctgagaacaccagcagtgagtgggccaagcccctgaaaggacac

SEQ ID NO: 80687 - DNA, 369 bp, Homo sapiens
tgtatgtagctattttatccatatttttaaatatatataattatttccatacgcctcctaatgaacgtttctgaatgaacatttgtgataactcagaaaccactgcttatctttttagcatgagtgttttatctgtcagtaatgtttttagcctcaagtaacagaaacagaactaagaatggtttaaaccagcagtaccaacctttttggcaccagggaccagttttgtggaagacaatttttccatggatgaagcggtgtggggagatagtttcaggatgaaactgttccactcagatcatcagtcattagttagattctcataaggagcgtacaacttagatccctcacatgcgcaattcaccatag

SEQ ID NO: 80688 - DNA, 255 bp, Homo sapiens
gacctgcccaccttggcctcccaaagtgttgggattacaggcatgagccaccatgcccagtcatttcctttattctttatgacacataaaacattcttagaacattagtaacagctttactacctaaatgattactgaaaacagttttttagtatgcccagtctcctcccaatttttagtttcactgtaatcatattatgaaatatatagtcattgcatcatatgctttctcccttatgactgatatttactctg

SEQ ID NO: 80689 - DNA, 243 bp, Homo sapiens
cagccacatcccaggacacattgtaggactgaagtcttttctgtagtgtccgcagatttgttttatggcaaccccaacttccagacaaaaagcatttccagtaaccctctaacagttccacagatgggacataatactttgcctaatactttaagagtaggtaattttggtctttttacctggaactaggctggaaataatagatttggcttggtaaatgaggggttaaattaaggatcactg

SEQ ID NO: 80690 - DNA, 1785 bp, Homo sapiens
agcgggctggaggagctcgaggctgaggctgccggggggctgtgggctaccgggccgccggcgcctcagcgatgttttactcagggctcctcactgagggcggccgcaaggagaccgacatgcgggaggcggcgtcactgcgacagcagcgccggatgaagcaggcggtgcagttcatccacaaggactccgccgacctgctgcccctggacggcctcaagaagctgggctcgtccaaggacatgcaacctcataatattctgcagaggcgcctcatggaaaccaacctgtctaagctccgaagcggtccccgtgtcccttgggcctctaagacgaacaaactcaatcaggctaagtctgaggggctaaagaagtctgaggaggatgacatgattttggtttcttgccagtgtgctggaaaggatgtgaaagccttggttgacacaggctgcctatataatctcatctctttggcctgtgtggacagattgggactcaaggagcatgtcaaatcccacaagcatgaaggagaaaagctttctctaccccggcatctcaaagtagtgggccagattgagcacctagtgatcacactgggctccctccgcctggactgcccagcagctgtggttgatgacaatgagaaaaacttgtcccttggtctacagactctccgatctctgaagtgcatcataaacttggataagcaccggctgatcatggggaagacagacaaggaagaaatcccttttgtggagacagtctctttgaatgaagacaacacttcagaagcataactacagcctgcagcatgtctgcacgtgtgcatgcatacacaccgggttgacagattgagaaaactgggtttgaaccaaatgccgtagtgacttgctgtggaccaagtccttccatctaatagaagctccaggggctccttcccattcagacctctctagactatagtctatgcttagagatcttgtctggttatggccattgttttttactactttgatcacttaacttatagaccttttttgacactgccagtctcacttgtggcctatttctctgcttcttccaggaatttgcttttattagtcaagtataggggctgccaggttctgtgtctccatagatatatgtgcttcttttcctatagctaaatgtataataaacaggaacctgacctttacctcctttcagctgtttcaaacaggtgccaggatacctatgtcttagaattagagtttcttcaaattgattcattgatttctcaagtatggattatgtgaaagagcccagggacattatccattacagtttaactctttcatttaaaggtccagagaggcaagtgaattgtctaagttcatatattaggtcagtgactgaagggaccaagaacgcagacctgatttccaagccaagactcccatgctgcctcatttgtattcaagcctttaacaggagggcaaagaggtgagaatgtgttaaaaaaaaaaaaaaaaaggcagagcatgggaggaatattctctggagatggatgctaggatgatttgggtagctctccctcctgtgtgccaagcccagtaaaagttccttgccccaaactgtcacatttaggccctcatcttggtgcctaaaaacgagcgtacaaagatgaatgaaatggtttctcactgtgaacctcttggaggaaaggaggaaccacagacagaggaatattaatccctctctgatatggaattgaaggcttaagtaaatcagagtgtcactgtcaga

SEQ ID NO: 80691 - DNA, 1100 bp, Homo sapiens
agcgggctggaggagctcgaggctgaggctgccggggggctgtgggctaccgggccgccggcgcctcagcgatgttttactcagggctcctcactgagggcggccgcaaggagaccgacatgcgggaggcggcgtcactgcgacagcagcgccggatgaagcaggcggtgcagttcatccacaaggactccgccgacctgctgcccctggacggcctcaagaagctgggctcgtccaaggacatgcaacctcataatattctgcagaggcgcctcatggaaaccaacctgtctaagctccgaagcggtccccgtgtcccttgggcctctaagacgaacaaactcaatcaggctaagtctgaggggctaaagaagtctgaggaggatgacatgattttggtttcttgccagtgtgctggaaaggatgtgaaagccttggttgacacaggctgcctatataatctcatctctttggcctgtgtggacagattgggactcaaggagcatgtcaaatcccacaagcatgaaggagaaaagctttctctaccccggcatctcaaagtagtgggccagattgagcacctagtgatcacactgggctccctccgcctggactgcccagcagctgtggttgatgacaatgagaaaaacttgtcccttggtctacagactctccgatctctgaaggtaagattgactccacttaccccttgatacttcctctctgaggcaggtatcctcttacacaggaactcatagtggtatcactgacaagttacctgttttcagtgcatcataaacttggataagcaccggctgatcatggggaagacagacaaggaagaaatcccttttgtggagacagtctctttgaatgaagacaagtgagtgcccaaatgggtcagatcaagtcacatccatttgtcatcagctgcgagcagggtggtggtggttctcagacaggacatggggttgtatcctgtctttggctttcaattatactacaaatccacccttccccacacccagagttcatcaccccacaaaaggaaatgactagctttgaaagcaaaattttacttgccttcagcttaacttttt

SEQ ID NO: 80692 - DNA, 1223 bp, Homo sapiens
agcgggctggaggagctcgaggctgaggctgccggggggctgtgggctaccgggccgccggcgcctcagcgatgttttactcagggctcctcactgagggcggccgcaaggagaccgacatgcgggaggcggcgtcactgcgacagcagcgccggatgaagcaggcggtgcagttcatccacaaggactccgccgacctgctgcccctggacggcctcaagaagctgggctcgtccaaggacatgcaacctcataatattctgcagaggcgcctcatggaaaccaacctgtctaagctccgaagcggtccccgtgtcccttgggcctctaagacgaacaaactcaatcaggctaagtctgaggggctaaagaagtctgaggaggatgacatgattttggtttcttgccagtgtgctggaaaggatgtgaaagccttggttgacacaggctgcctatataatctcatctctttggcctgtgtggacagattgggactcaaggagcatgtcaaatcccacaagcatgaaggagaaaagctttctctaccccggcatctcaaagtagtgggccagattgagcacctagtgatcacactgggctccctccgcctggactgcccagcagctgtggttgatgacaatgagaaaaacttgtcccttggtctacagactctccgatctctgaagtgcatcataaacttggataagcaccggctgatcatggggaagacagacaaggaagaaatcccttttgtggagacagtctctttgaatgaagacaagtccagagaggcaagtgaattgtctaagttcatatattaggtcagtgactgaagggaccaagaacgcagacctgatttccaagccaagactcccatgctgcctcatttgtattcaagcctttaacaggagggcaaagaggtgagaatgtgttaaaaaaaaaaaaaaaaaggcagagcatgggaggaatattctctggagatggatgctaggatgatttgggtagctctccctcctgtgtgccaagcccagtaaaagttccttgccccaaactgtcacatttaggccctcatcttggtgcctaaaaacgagcgtacaaagatgaatgaaatggtttctcactgtgaacctcttggaggaaaggaggaaccacagacagaggaatattaatccctctctgatatggaattgaaggcttaagtaaatcagagtgtcactgtcaga

SEQ ID NO: 80693 - DNA, 1645 bp, Homo sapiens
agcgggctggaggagctcgaggctgaggctgccggggggctgtgggctaccgggccgccggcgcctcagcgatgttttactcagggctcctcactgagggcggccgcaaggagaccgacatgcgggaggcggcgtcactgcgacagcagcgccggatgaagcaggcggtgcagttcatccacaaggactccgccgacctgctgcccctggacggcctcaagaagctgggctcgtccaaggacatgcaacctcataatattctgcagaggcgcctcatggaaaccaacctgtctaagctccgaagcggtccccgtgtcccttgggcctctaagacgaacaaactcaatcaggctaagtctgaggggctaaagaagtctgaggaggatgacatgattttggtttcttgccagtgtgctggaaaggatgtgaaagccttggttgacacaggctgcctatataatctcatctctttggcctgtgtggacagattgggatgacaatgagaaaaacttgtcccttggtctacagactctccgatctctgaagtgcatcataaacttggataagcaccggctgatcatggggaagacagacaaggaagaaatcccttttgtggagacagtctctttgaatgaagacaacacttcagaagcataactacagcctgcagcatgtctgcacgtgtgcatgcatacacaccgggttgacagattgagaaaactgggtttgaaccaaatgccgtagtgacttgctgtggaccaagtccttccatctaatagaagctccaggggctccttcccattcagacctctctagactatagtctatgcttagagatcttgtctggttatggccattgttttttactactttgatcacttaacttatagaccttttttgacactgccagtctcacttgtggcctatttctctgcttcttccaggaatttgcttttattagtcaagtataggggctgccaggttctgtgtctccatagatatatgtgcttcttttcctatagctaaatgtataataaacaggaacctgacctttacctcctttcagctgtttcaaacaggtgccaggatacctatgtcttagaattagagtttcttcaaattgattcattgatttctcaagtatggattatgtgaaagagcccagggacattatccattacagtttaactctttcatttaaaggtccagagaggcaagtgaattgtctaagttcatatattaggtcagtgactgaagggaccaagaacgcagacctgatttccaagccaagactcccatgctgcctcatttgtattcaagcctttaacaggagggcaaagaggtgagaatgtgttaaaaaaaaaaaaaaaaaggcagagcatgggaggaatattctctggagatggatgctaggatgatttgggtagctctccctcctgtgtgccaagcccagtaaaagttccttgccccaaactgtcacatttaggccctcatcttggtgcctaaaaacgagcgtacaaagatgaatgaaatggtttctcactgtgaacctcttggaggaaaggaggaaccacagacagaggaatattaatccctctctgatatggaattgaaggcttaagtaaatcagagtgtcactgtcaga

SEQ ID NO: 80694 - DNA, 869 bp, Homo sapiens
aaatataatgtcaaagaatttgagtaagatagtcacatttttagataggttataatacaatgataatgttggtatgctctccataattatttttagagaggcctttttaaataaaccattcatcttatatttgataactgtttttaacccgttgcatgtttgggcagtatcagattatctttctcatgtcatttgtgtgtttctttactgttttccagcgacgagtagaacagcccctctatggtttagatggcagtgctgcaaaggaggcaacagaggagcagtctgctctgccaatcctcacgtcagtgatgctagcaaaacctcggcttgacacagagcagctggcgtaaaggagagctggcctctgcttcacttttgtttcagtgagtacaaagcctaagttaattcagatcctttccattgccctagcgctccttgatgaggttggattaattattttgatagagagataagggacatttctaatactttttttttaaatgtgatctccccttatcatcattcccaaacgtgtctaattctacatcacttctaaatatattgtgtttttcccagtctcccttggttcaagctcctgagggagactgctttgtcaaagcctgaacccacaatgggaaggaaggaaagcataatcttagattgacaaagaagaaaatacagatcaaattccattagtaaccaagatataattaaaaatagagtctccgagttccagccatcatctatgtaagttaatactcaagtcagtacagttttagtatgtaggcaggcattctcacagcaagttactggtcatttaccccgtgtagtatttgggctatgtacacacttgctttcgtcaccct

SEQ ID NO: 80695 - DNA, 1610 bp, Homo sapiens
  misc_feature (1100)..(1100): n is a, c, g, or t
tagtagagatgagatttcaccatgttggccaggctggtcttcaacttctgatcttagctgatccacctgcctcagcctcccaaagtgctgggattatacgcctgagccaccgcacccagcctcaaatcataaacttttttttgttttttgagacgaagtctcactctgttgcccaggctggagtgaagtgacacaatcttggctcactgcaagctccgcctcccaggttcaagcgattctcctgcctcagcctccccagtagctgggattacaggtgtgcgccactgcgcctggctaattttttgtatttccagtagagatggggtttcaccatgttggccaggctggtcttgaattcctgacctcaggtcatccacccacctcggcctcccaaagtgctgggattacagacatgagccactgtgctcagcctcaaatcataaactttttaaaggtttatccctgaccctctaaattaggttatgtgccttgttatatgctcttttagcacttatcctaattgtgattgtgtatttattatatgattgtttattcaacagtttctttcaacaaatatttaccaagtgtttagtaaatcttgttttggattgtaagcttcattaaggcagagtaaggactgggtctgtggtttctcttaccatgtgtacctagcacctagcacagtgcttagacatagggagtacttaataaatagtcattgaatgtatacattaaaatggcgttaataatgctgcctatctgatgaggctgttgtgagccttcaatgaaatcgtgtgtaggaagtgctagtttgctcacaggctggtggtaacagtctactgtggtcattgagagcagttattgtggacacaacccccagttctggtcaccccacccactagctctgtgaactcacataggtacttaatatctctgatttttattttatttatttgtaaaatggaactaataattacaaccaccttataggacagagtcttgctctgtcacccaggctggagtgcagtggtgtgatctcatctcactgcaacctccgcctcccaggctgaggcaggagaatggcatgaacccgggaggcngagcttgcagtgagcccagatcgtgctactgtactccagcctgggtgacagagcaagactacatctcaaaagaaaaaaaaaaaaaagtattattgagaatataatatagttaacctgaataggttaattatattgtggaacctaaaccgtataaatttaaaatgccttagaatgcccagtcagcaagtgacagtattagaaatcaacctggattttagaccgctgtgtgttcatggataatgtttgtgtgtttaggagactattctgaatagtggttcacagtcctttacatgcatcccctgtgcattggatgcttcactagccttttctgactaaagcatatgaaaatacaagtgaaaaaggcaagttattacaggaataacttttcattttctctaattttcatattttaaaaattcatttgtaagcatttgatactttaaacctgtttacaggaacttggtataaaccaccatgtccagcctgggtgacagagcaagactacatctc

SEQ ID NO: 80696 - DNA, 928 bp, Homo sapiens
agacaggatcgttggcaatctaggagaatttcttaaatctcaagaggtatacaactccctggagcacatttgaattttatctaaatcaccagctcttgtacagttcagttagatagttgagcactcaggtagcttcttctcttcccttctgattgctctctgtttccaccagatggcgcatttgttccttagagagttgtgtgtcaagtctcctgtgagatccttttctattcaaagttagtttcatttctggagtaacgtgtttctacattgttcagtgcacagtagtgagaattcatacatttgattccagaattaacatgtgtttgaagtgtaggtgtagtgggacataaggaacccagcagaggacttgaagaatgagatgagacaagcagatttcatttcttaagccatgtgattctaggccatttgtgtgagcaagtgctttttcccacccccccgagaaaggtaatgagaagagtgtgatgacatataacatgttgagactaatcctaaatttgttttacctttgtctctgtagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaaggttagtgaataatgttggtctaaactctgtatcccaagatactcaatgtgtgtcattgtgtggcttcttattccttacttgagatgaaaatatttaaaagtagagctttttaggaacatgatttgacaattagaattttttccttacatggacaccagaccaaccatccagagtgttaatttg

SEQ ID NO: 80697 - DNA, 440 bp, Homo sapiens
gcggccgcccgggcccgggcccgcgtcgggcgcctggctctgtacgcgagcccggggatctgcggccttcgtgccccccctcccccgcccgccctctcgtggagcccggcgccggcggcggctgcccgggcggggggttgcggcgctcaggagaggccccggctccgccccgggcctgcccagggggagagcggagcggtccgcagccgggtcgggtcggggcccctcccgggaggagcgtggagcggcggcggcggcggcggcaggtgagaggctgagccccgggcgggggaggactccaggcctggggcattaaccgtcctggggacccctttggcctgaggagcctgcgacctgggcccagctcggggccggctccggaccgcagctcctgggcgctgaggcgggaggggctccctgagggctgcgggtcgctgagg

SEQ ID NO: 80698 - DNA, 1189 bp, Homo sapiens
gcggccgcccgggcccgggcccgcgtcgggcgcctggctctgtacgcgagcccggggatctgcggccttcgtgccccccctcccccgcccgccctctcgtggagcccggcgccggcggcggctgcccgggcggggggttgcggcgctcaggagaggccccggctccgccccgggcctgcccagggggagagcggagcggtccgcagccgggtcgggtcggggcccctcccgggaggagcgtggagcggcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagcgacgagtagaacagcccctctatggtttagatggcagtgctgcaaaggaggcaacagaggagcagtctgctctgccaatcctcacgtcagtgatgctagcaaaacctcggcttgacacagagcagctggcgtaaaggagagctggcctctgcttcacttttgtttcagtgagtacaaagcctaagttaattcagatcctttccattgccctagcgctccttgatgaggttggattaattattttgatagagagataagggacatttctaatactttttttttaaatgtgatctccccttatcatcattcccaaacgtgtctaattctacatcacttctaaatatattgtgtttttcccagtctcccttggttcaagctcctgagggagactgctttgtcaaagcctgaacccacaatgggaaggaaggaaagcataatcttagattgacaaagaagaaaatacagatcaaattccattagtaaccaagatataattaaaaatagagtctccgagttccagccatcatctatgtaagttaatactcaagtcagtacagttttagtatgtaggcaggcattctcacagcaagttactggtcatttaccccgtgtagtatttgggctatgtacacacttgctttcgtcaccct

SEQ ID NO: 80699 - DNA, 1133 bp, Homo sapiens
agaagaggacttctgagctgctttaaaacttttcaatatattactgtttgatgcagcacatagtagtctaccacttgtatgctatatttacttgagatttacctgcatttgatctttcagtgaaataattactgtgagttttgttctacagaaaattgcctcctcacattttagtgtttatggtttcacagcctactttttctttttcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagcgacgagtagaacagcccctctatggtttagatggcagtgctgcaaaggaggcaacagaggagcagtctgctctgccaatcctcacgtcagtgatgctagcaaaacctcggcttgacacagagcagctggcgtaaaggagagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaaggttagtgaataatgttggtctaaactctgtatcccaagatactcaatgtgtgtcattgtgtggcttcttattccttacttgagatgaaaatatttaaaagtagagctttttaggaacatgatttgacaattagaattttttccttacatggacaccagaccaaccatccagagtgttaatttg

SEQ ID NO: 80700 - DNA, 1728 bp, Homo sapiens
  misc_feature (874)..(874): n is a, c, g, or t
ttttttacataatgaaaagggttttttatttcagagaaattttgttttactgtttctttgattatttcatttcctctgttcttttctctagaaagccattagatagtttcagggtctctgtgctattcatgtttcttttcttttgtgctccatttaaccttttgttttatctttgggattacagacatgagccactgtgctcagcctcaaatcataaactttttaaaggtttatccctgaccctctaaattaggttatgtgccttgttatatgctcttttagcacttatcctaattgtgattgtgtatttattatatgattgtttattcaacagtttctttcaacaaatatttaccaagtgtttagtaaatcttgttttggattgtaagcttcattaaggcagagtaaggactgggtctgtggtttctcttaccatgtgtacctagcacctagcacagtgcttagacatagggagtacttaataaatagtcattgaatgtatacattaaaatggcgttaataatgctgcctatctgatgaggctgttgtgagccttcaatgaaatcgtgtgtaggaagtgctagtttgctcacaggctggtggtaacagtctactgtggtcattgagagcagttattgtggacacaacccccagttctggtcaccccacccactagctctgtgaactcacataggtacttaatatctctgatttttattttatttatttgtaaaatggaactaataattacaaccaccttataggacagagtcttgctctgtcacccaggctggagtgcagtggtgtgatctcatctcactgcaacctccgcctcccaggctgaggcaggagaatggcatgaacccgggaggcngagcttgcagtgagcccagatcgtgctactgtactccagcctgggtgacagagcaagactacatctcaaaagaaaaaaaaaaaaaagtattattgagaatataatatagttaacctgaataggttaattatattgtggaacctaaaccgtataaatttaaaatgccttagaatgcccagtcagcaagtgacagtattagaaatcaacctggattttagaccgctgtgtgttcatggataatgtttgtgtgtttaggagactattctgaatagtggttcacagtcctttacatgcatcccctgtgcattggatgcttcactagccttttctgactaaagcatatgaaaatacaagtgaaaaaggcaagttattacaggaataacttttcattttctctaattttcatattttaaaaattcatttgtaagcatttgatactttaaacctgtttacaggaacttggtataaaccaccatgtccagccctttgtctcatatttgaattgttttactttcttcttggccacgtggccctgacttctcactttcataagaaggggtttgtattgtggagatacaaattatggagttgtttgcattaatacaagtgtttgtggaaaaagatgccaaactttcctgtgattggtaatgcacctttattgtaggctcagcaaaacagtccctcatctacgggatctggcaacacagagcattcctgcagctcccaaaaacagatctccatccagcacagacagacccaggtaggttggtgatcgataatcaattgaggggcatacctgctgtgtaggaataagggctaacctgtgtagtctgtcattcttctctgacttctct

SEQ ID NO: 80701 - DNA, 1189 bp, Homo sapiens
gcggccgcccgggcccgggcccgcgtcgggcgcctggctctgtacgcgagcccggggatctgcggccttcgtgccccccctcccccgcccgccctctcgtggagcccggcgccggcggcggctgcccgggcggggggttgcggcgctcaggagaggccccggctccgccccgggcctgcccagggggagagcggagcggtccgcagccgggtcgggtcggggcccctcccgggaggagcgtggagcggcggcggcggcggcggcagcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagcgacgagtagaacagcccctctatggtttagatggcagtgctgcaaaggaggcaacagaggagcagtctgctctgccaatcctcacgtcagtgatgctagcaaaacctcggcttgacacagagcagctggcgtaaaggagagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaaggttagtgaataatgttggtctaaactctgtatcccaagatactcaatgtgtgtcattgtgtggcttcttattccttacttgagatgaaaatatttaaaagtagagctttttaggaacatgatttgacaattagaattttttccttacatggacaccagaccaaccatccagagtgttaatttg

SEQ ID NO: 80702 - DNA, 1044 bp, Homo sapiens
gcggccgcccgggcccgggcccgcgtcgggcgcctggctctgtacgcgagcccggggatctgcggccttcgtgccccccctcccccgcccgccctctcgtggagcccggcgccggcggcggcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagcgacgagtagaacagcccctctatggtttagatggcagtgctgcaaaggaggcaacagaggagcagtctgctctgccaatcctcacgtcagtgatgctagcaaaacctcggcttgacacagagcagctggcgtaaaggagagctggcctctgcttcacttttgtttcagctcagcaaaacagtccctcatctacgggatctggcaacacagagcattcctgcagctcccaaaaacagatctccatccagcacagacagacccagtccgacctcacaatagaaaaaatatctgcactagaaaacagtaagaattctgacttagagaagaaggagggaagaatagatgatttattaagagccaactgtgatttgagacggcagattgatgaacagcaaaagatgctagagaaatacaaggaacgattaaatagatgtgtgacaatgagcaagaaactccttatagaaaaggttagtgaataatgttggtctaaactctgtatcccaagatactcaatgtgtgtcattgtgtggcttcttattccttacttgagatgaaaatatttaaaagtagagctttttaggaacatgatttgacaattagaattttttccttacatggacaccagaccaaccatccagagtgttaatttg

SEQ ID NO: 80703 - DNA, 516 bp, Homo sapiens
tcgttggccccctcccccaagtctaagaatttttggcttaaagagaaagagtaagtgaagaatcctctatatccattcttcactagttctaagaaggatgaaaggcaagtgcacaacactaaatctcactgcagcttacagagattttccagatgataatttatttacctttagtttaactttttctctcagaactccagataatgcagtagtaacttataagcagcacagtatcttctaacagcattcatcatgagatagacaagtcctcaactacccgagacagtgttttaccccttactcatcctgctcccctttcactgctgttgcataggtggataatttgatttccaccctgtgtaatctctagaggaaacatagctcagagatatggaatagtcaaaatgaatgggttgtttgagttatttctctctctctctcgctctctgtgtgtgtgtgtgtgtgtgtgtgtgtgtgtgtttgctgtccagtatctccatccctttttatgtttga

SEQ ID NO: 80704 - DNA, 320 bp, Homo sapiens
atgacctcaggcaatctacatgccttggcctatgaaagtgctgtgattggccagatgcagtggctcatgcctgtaatcacagcactttgggaggccgaggtgggcagatcacaaggtcaggagatcaagaccatcctggctaacacgatgacacccccgtctctactaaaaatacaaaaaattagccaggcgtggtggtgggcacctgtagtcccagctacttgggaggctgaggcaggagaatggcgtgaacccaggaggcggagcttgcagtgagcagagattgagccactgcactccaccctgggcaacagcgtgag

SEQ ID NO: 80705 - DNA, 415 bp, Homo sapiens
ataacaacctactcttcagcccacctgagaggacaggatgcttcaagaaagacagtgagcagcaggtcctttaaaaatcaaaggaaaacaggctcctggataggtgtgagatagaagtgaattatggcacatacgagagcaacaataaattatcctttactaacagtaacctaagggaaatgcccggcattgtgtctggcacagactagatactcagtagttcccttctcacacttgctcagccctgtttgaacccagacagagagcagctcaaaatatgcaagtattacatactcacagaacctggagacaagagaagcggcttctaggcacatgggctcccatccttgcagcagctggtatagaggttgcatgacaacttgtgaggattctgcagtagcgtgggctcagctac

SEQ ID NO: 80706 - DNA, 489 bp, Homo sapiens
aggaggagctgatagagccgggtataagacagtctggcaatatggtgaaacccatctctactaaaaatacaaaaattagctgggcagggtggggaagaggagagcttgctcagctatgctctgacaggaggcgatggcacagagccctggaaggaacggcaaaagggcaggggcacttctgttctgagagcaggggacaggctctgaggctagtgtcagcagaggcacccaagggcacatgaccaaagagtggtgggggttcagaagccgtcagaggtgctttggagagtcttaagtggggcagtgatgccacttgactggtctggggaacttgggccagaaaagtagctatgaaggggatgagaagtggccagagtctggacacatttaattgggatcctatgtatgacacctggttcctgaatcagctagtgtgtcatgctgccacatggtgtggactcagcacttacagtgccttcttctgaccag

SEQ ID NO: 80707 - DNA, 453 bp, Homo sapiens
ggatggtggggctcagttctacaatgatttaatgtcttaagaaatgaggacaccttttgtgttatttcagaaagtctaacactttagaggctccataatatccactctaaatggaagaaatcttttgatatatcttgagagaatcttggttgccattcatccgctacttttcagagaggagcagtgaaaccatcaggccgcttgttgcctggaataggcctgagtatcctatgtgttctctccatccctcttagacttggatatcaggattcccataatccccattgcccagtgttttatttgccacagcaaaacttagtattgataaaactatcaggtcggtcatttaggattgactttctgtcacatgactagagaagcaagttcaatgaatattagatttggccaaaccctgtttcttgtaccgttacgtttgtgtaactttatgagaat

SEQ ID NO: 80708 - DNA, 482 bp, Homo sapiens
aaaatcaaccttaagactggtaaggcggcatctcagaaatctggaagttttacaatcaataaaagttactgtttgaaaaacaaaacaaaaccaactctaccaggctacacaagaaaatatattctatatttcagaggtaaaccatatgaggattgagacacagaaaagagtattctaagagccaaaatctcagatcaggtggccttcagttaatgagaagcttacaatgaagaatgttttgttctaaagaagattactgagatgagaattatgatctttatcagagatcatacctccagactgatatagccctagagctctcctcacaaaatgccctaaccttcaagagatgctttttccggctgggcactatatacaagactaacaggtctctccatatcagagcagtcaactcaattcctaataaaaaaaaaaaaaagaagaagaagaagaccaggcacgtgactcacgcctgtaatccc

SEQ ID NO: 80709 - DNA, 347 bp, Homo sapiens
gacactgctttggaaaaaaagcaaagcccactcctgattctttgcttacttgggacaagtaataaaacccctattgatcaaaacctgcgttcttttggagagttgtttgttactaggcaaatgaaccccctttttcttgggtaacattttcatttttcttggggtatctagaagtaaaatggctggatctgacagtagatatatgtttgactttttaagaaactgcaagccgggcacagtgacccatgcttataatcccagcacttagggaggctgaggcgggaggatcgcttgagcctaggagttcgaggccggcctgggcaacatggagaaaccctgtctctaga

SEQ ID NO: 80710 - DNA, 1018 bp, Homo sapiens
  misc_feature (51)..(52): n is a, c, g, or t
  misc_feature (101)..(101): n is a, c, g, or t
  misc_feature (374)..(374): n is a, c, g, or t
tttgaatgagacagagtctcgcgctgtcactcaggctggagtgcagtggcnnaatcacagttcactgcaacctctgcctcctgcattcaagcgattctcgngcctcagcctcccaagtactgcagttacttttgcaccaacctaatagctcggattacaagtatgcaccaccatgcccagctaattttgtatttttagtagagaccaggttcactatgttggccaggctggtctcaaactcctggcctctagtgatctgcctgcctcggtctcccaaagtgggattacaggcatgaaccaccacgtccagccagtcattttcttaagtaggttcttcccagcctgcaaacccagtgaaagggcttattctttcnccattactgtggggaaaaagtcctgtagaggctttccataggccctgtgtgactcacgtgtctatacctgaatcaactgttacaaccaagcagatgcagagactgcgtgccctctcctggagctaggagctaggtgagtcaatcctgcactttctctacaaggcttgcaaaggtgagcaagaagattccccaaagtgaaatcagggtgctgttaccaaaagaagctatgctggcaggcaaaaaacaacagctgtttcccatagggcaaaacctgaaacacccaattactatcccattgtttgcttcaaaattaaattttgtttgaccccaactagttctagtcaagtttttgctcgatggaccacgtgaaaaaaggataaacaatgtctctatataatgcatgatcaggtggtttatgaagatgtcaagagcactgaacaaaatccaaatgctcacataaaatgggattaggtttcataagccacccaagaaaatcagtctcattattttatgtaataatgtattactgtgcccagagctaacctgtagctctaggggagtacaatgtgtttgtattattcttcattgtacacagtgcctcagacatagtaggtattcaataaatatttgttaaatcaaaaaaa

SEQ ID NO: 80711 - DNA, 935 bp, Homo sapiens
  misc_feature (51)..(52): n is a, c, g, or t
  misc_feature (101)..(101): n is a, c, g, or t
  misc_feature (374)..(374): n is a, c, g, or t
tttgaatgagacagagtctcgcgctgtcactcaggctggagtgcagtggcnnaatcacagttcactgcaacctctgcctcctgcattcaagcgattctcgngcctcagcctcccaagtactgcagttacttttgcaccaacctaatagctcggattacaagtatgcaccaccatgcccagctaattttgtatttttagtagagaccaggttcactatgttggccaggctggtctcaaactcctggcctctagtgatctgcctgcctcggtctcccaaagtgggattacaggcatgaaccaccacgtccagccagtcattttcttaagtaggttcttcccagcctgcaaacccagtgaaagggcttattctttcnccattactgtggggaaaaagtcctgtagaggctttccataggccctgtgtgactcacgtgtctatacctgaatcaactgttacaaccaagcagatgcagagactgcgtgccctctcctggagctaggagctaggtgagtcaatcctgcactttctctacaaggcttgcaaaggtgagcaagaagattccccaaagtgaaatcagggtgctgttaccaaaagaagctatgctggcaggcaaaaaacaacagctgtttcccatagggcaaaacctgaaacacccaattactatcccattgtttgcttcaaaattaaattttgtttgaccccaactagttctagtcaagtttttgctcgatggaccacgtgaaaaaaggataaacaatgtctctatataatccacccaagaaaatcagtctcattattttatgtaataatgtattactgtgcccagagctaacctgtagctctaggggagtacaatgtgtttgtattattcttcattgtacacagtgcctcagacatagtaggtattcaataaatatttgttaaatcaaaaaaa

SEQ ID NO: 80712 - DNA, 619 bp, Homo sapiens
tagctggatatacacaatttctaaaaattctgtggcaatggcaaattaggttttgacttacagtaataccagcaagaaactactgtcctcatttcaaagaattctcaccaatagttttgttttgctgggagaaacaatactctaaacgataataagggggatatccacgactctcaaaaaagtgaatgtaaaaagacttcaggcaaaaatcactactgtcaaggaatgctggttctcactgatttgtttcatgatctggatgtggtttacaaaggtgagactggtttgtgaaacttacctaagcacttaagatctgactgcttttctgtaaacacgattattcaataaaaagttttttaaaaaaatcaaattttctattctaatgagaaattaccagttgtcattgatccataacacggcaatattaacaagccatcgaggatggtatcttgaacatcataatcataatcaacagactctgccatctgaaaaagtaactcacaacttttttctatttcaaactggcctaaaatgggaagaaaaaaataacttcagcaactgaacagaaaaattaatttaaaaataaagaaaatgtcaagattaaaattaattttgccta

SEQ ID NO: 80713 - DNA, 266 bp, Homo sapiens
tacccatatgatgaatactggcatgggattcttcccccatcccacaaaaggaaattatttttctctacaatcccaaagtcaaatacaactagaggtaataaacaataccagtgcctctttagacataccagtgcctctttagatttgtgcaaacagagcatgaagtgagggatttaagtgctaaaaaacaatcccacttgctaatctgaaccctaaaaaccacaatgcaaatcagaattttagttagtatttactttttttttttt

SEQ ID NO: 80714 - DNA, 753 bp, Homo sapiens
acctcggcctcccaaagtgctgggattacaggtgggagccaccgcacccagcctgcaggtcttcttcttttttgatgtaggtgcttatatctataaacttccctcttagtactgcttttgctgtattccataggttttggtatgttgcattttcattatcatttgtttcaagcaactttacaatttccttcttaatttctccactgaccaattggtcattcagaagcagattatttaatttccatatgtttgtatggtttccagaattcctcttgtcattgatttctagtttattccatgtattctatgacacaatttaaattatttcaatttttttggagagttttaagacatgctttttgaactaacatatggtctatccttgagaatgatgcatgtgctcgggaaaaatatgtgtattctgtagctgttggataaaatgttctgtaaatatctattagatccatttgatctatagtgtagattaaatcccatttaatctttcttttgtctgatttttcagtatatattgagataatctttgtcgatttactgtctggaagatctgtcctgtgctgaaaacggggtgttaaaatctccagctattattgtattggtctctctctcttttatttttatttttatttttttttgagacagagtttcactcttgttgcccacgctggagcgcaatgttgcaatcttggcttactgtagcctcctccacctcccaggttcaagcagttctcctgc

SEQ ID NO: 80715 - DNA, 515 bp, Homo sapiens
agtttccctatgaggaaatctactgtaacttaagagttccccaaagcgtaggtttgattaggccaacaaacttgttcagtaaggtagacagctaatgctattatcaaaatcctcttctccatattggactcaaccatctagtaaaaagctaagaaactaaccactctgggtgtctgagttaatgtacagtttaaacaggcagtaaatgttcccaagagcctctacctcccctcctggcacagtaaatgaatataaaaatatctctgaagttacaatggaattaaattatcatattttgatgattctgatatcccagaaagaatctgagggctccctgcagagatgcaacagaaagtttaagatgacaaatcagggctaatagaagatagacaaaaggccataaattgatctctgaaggtcaggctcacgcatgtaatgccaacactttgggagcctgaggcgggaggattacttaagcccaggaattcaagaccagcctgggcaacatggcgaga

SEQ ID NO: 80716 - DNA, 231 bp, Homo sapiens
gtgtgtgtgtattcatctacatgtttatatacggctcccatccttttggacaaaaatgaaatcagattgtacctgttcatttaatactatacctaccctgtatcattaactaacagttcctctttacctcattccatacattttgctgtatgtcagacatttaacttttaggattactaaatgagacctggaactatttttttttaaataaataattgctacatgactgag

SEQ ID NO: 80717 - DNA, 824 bp, Homo sapiens
ggaaaagaaaataatcatgttccaaataccctaaaatagctactgttaatgcttagttgaatttacttatagtcactctgtatacatatataatttcatgtttcagcttccatttttgtaaattatttaaaaattataaatgatattctttcaaacaaatatgcaaactcattaaagtttttttctatcataaataatacttttagagtccattttcataaattaatctttcttctggttaaatttaagacaaagtgttttaggttgctaaatttcttcaaaaacacttactaatttctattcctattatcattgagtataagtgcttttctcactgtaccactctaatattattgtctttttagtcattgctaatttgacaggggaaaatagaattttcttatttttgaaacattttctatattcagaactttgtcaacatcttcaatagttttacacttagtgggcagtttcacaaaaggaaatcagagggaaatatggccattatttcaaggaaggtaaagcacaaataactaaataaattgctcttgaaccctgggccttctttctcttgtgtagaagccagccacagcgagcttttgctctctgtactcacccttggttcatcattcctcaccgaaaggagaacctagcttctgggatttagactagaggttttcagcaagagatgatgtagcagtgatggtaacatcagtttacctatcactaatggcactggtaaatgttaaacagtagaatcactagggataggggaaagccctgtttataatgtttgcctgtttctgtggtgtaaatattctcat

SEQ ID NO: 80718 - DNA, 134 bp, Homo sapiens
atcacaaacagttgtaaatatattttggtcgtataaaaaatatttgggggtttaccaaaagcaagataaaattaaatacccaataatagtgcatacattagacaggggggaatggaattaagatattgaatcgg

SEQ ID NO: 80719 - DNA, 345 bp, Homo sapiens
ggacatccaaactatatcacctactacattgcatggctgttccgtgtcacacctttggaagttagaggggtgggggacaagagaaattgaggcaaatatgaagtttatgctcgctgagctgtgagtaataagtcctttgtctcttacacagatgtctttttttttttgccagcatccattaaagcatggccaactaaattgttagcttgcaaggaaggttagacctcttcactatttttgacttgtatatcttatagtccaacaccctataggatctgacagaatcaggtagtcaccatccagaatagaaaatcccggtagcactaagctcttttgttaggccat

SEQ ID NO: 80720 - DNA, 432 bp, Homo sapiens
aggaaaagccctttgtttggggctcagactttctggacatatgtccagctgggccagtgatgaccttaatagactctcctgaaccttttttggtctctccagtctttgattgtcctgtaacatttctgggggcttatccgggattggagatggcagattttctgtcttctttgcctgtgggctagagccccaggatgtgggagatctggggtccttggcaccgctgggagagtttcagcctggaaggagaatggccctcccgcattccagagccttcccctgacagcaccaaaggaaccagtggaaagggttgcaggacagtcacaggagcagtgcacagacatctgaaccatgttctttgaagaaatgcctcaggatgttgatcccacttgtttaaaatttccattggaagctctgctgttgtctgcagct

SEQ ID NO: 80721 - DNA, 397 bp, Homo sapiens
aaaaatacaaaaattagctgggcgtggtgacacacgcctgtaatcccagctactcgggaggctgaggcaggagaattacttgaacctgggaggcagaggttgcagtgagctgaagatcgtgccactgcactccagtctgggtgacagagcaagactgtctcaaaaaaaataaataaataaattattttgttaactgcagtttctgcatgaaatgaaatgtgatgggacactatcgtattttgtgattatgacaatacatctcaatactaagaatctaaaatatagaaataattacataaaatattatcaaaacataccatatagaaaatataaatccttaaatacccctgctggttccctaccactgctctctgatattttcttcacattaattgat

SEQ ID NO: 80722 - DNA, 879 bp, Homo sapiens
gctgtattttattccttagcacttatcaccacttgacagttgtttattttctatccccttcagttagactgcatgctccatgagggcagtgaccttgagtattttgtttgctgtttatccccagtgcctagaacagtgcctggtgcagggtgtatgccacctaagcctcagcagaatcactgtccagtgacattcatcacctggtcttagtggtggctcttccctagaagtgaggtgaggtctgtgtcccattgttgttgggctggaggcagctggttttctcctattcgttgatgctcagctggaccggtgttgtgatatttaaggaaagtttcatcctatccctttttgccaacagaattttaatttgatgactttatggtcatttttctttataaatacccatcttcatggatttaaatatataatcattgtatgcttatggtttacataaatatgagtattcatatgtttgtttttttgaagagggtggcacatggagcaaacactttttacttaggcatggatgctcaggtagtggtgttgatgccttctttgtgtactcttgaaattcctgcaagctcccaaaccttattatactcagatctacgtaccaaattgcttaggtcccagtgggccagacttctgctgagcgttagctaactcagggatagagttgctgtccttcaagtataatttgtctctcagatggctttcccatagctgattctcaggctttgaatatgggttctgttagtccacagggcattgactccatttgcaggtgtgtgtttgtaacatatagtcaaacctctaacatttggaataatgagatgagatgagaatgagtaggaggaggggcagtctggtttagtgaaa

SEQ ID NO: 80723 - DNA, 793 bp, Homo sapiens
gtcgaccttctggtcaaatgcaacgaagttcagaatcaaaagaaatacacttaattgaaattttaaaaataacataaaagaaatttgaagtatgcataggtatccccagttggtaaatcactattgttagaacccatagaatctgcatttgtggaaatgtttgataaggatatcagccttttaccatcttaaactgtgaaaatcgctttatccaaggcaagtaactggactgggctgctacttagtctttttcagctttaagaaactgtcacttcaaaatcttagattaagcactttgggaggccaaggtgggcagatgacttgaggtcaggagttcgagaccagcctggccaacatggtaaaaccccgcctctactaaaaatacaaaaattagccagaagtggtggcactgaggcatgagaattgcttgaatgctagagggggaggtttcagtgagctgagatcgcaccactgcagtccagcttgggcaacagagtaagactctatctccaaaaaaaaaattagattaatttgtttgcatacatgctaataaaaaaaaatcagtgagagactgaattcattagcacaaactccagctgccctgggtgtgcctcagatgcagatgaagagtaccactgtttggtaagggcttgtttttccagataaagcaaagacttgaaacagctgtccacagtgacagtacaaatccccaaaatggtgtcaagagagaaaaagtgctcaagttagaatatgatttctgttctactttataatgtgtgtgctgtggtttttg

SEQ ID NO: 80724 - DNA, 380 bp, Homo sapiens
catcgtgtatgaaggtagccattttgtacatgttaccttgttaaaaacaaaagagcagcaacatgtttagagtggtgtctatagatagaacactgctgttatgtttaaggaaaattggggcagggggcagaaaagatcaatatgactagttagaagactattaaggagaactttgtacatgaattatggatgtaagaattagaaaaaaaaagatgatcatgttcagaattttagcttttttacaattgtagtggaaaagaaaactcctagagtaatgaatcaatggtatcctacaaaaagagaggtgccaaaaataccatgaaatattatattaaaaaattcacacgaataggtagttataatatgtaaagacagacttc

SEQ ID NO: 80725 - DNA, 552 bp, Homo sapiens
tctctctgcaaattaagttcttattaaaaactgccaatcattgacgatatataatgatgagatcctgaacaaaagaggcaaagaaatgctcctacttgaaaaatacacattccctatagactgcctcctgtttagtccaacttagatcactcagatccttcctgggatcaaatatatttttaaacctaagacaaagcgaagcaggtgtcacttgggtgatagggaaaaaagcttgtatttcctggttaatgtttagcttttgtaatgctatttaaacacacctaaggtgcctttccctcatctcaggtgctttctctgtaaagtttcactcccacctttcttttctctgcatggccgtccagtcttgcccatctacatccagagctgttaactagtagtgtcattacctgtgaaaaacatgtagaagcttccttgaaccacccagaaatccactcaaatttggggattgtcattccttttgtgaataattaatacaattcagttgttttttaaatattctaataaaaaaggaaattttctcaaaaaaaaaag

SEQ ID NO: 80726 - DNA, 492 bp, Homo sapiens
tgaaacaacataaatttatgacctcacagtacctgtacatcagaagtccagattggcttgtctggtttctctgctctgggtctaacaaggccagtatcaaggtgtcagccttccagggctctgattgggagactagggtagaatcagcttaaagcaaattcagcttgatggcagagtccaggtccttgtatgtgcaggactgaggtccctgttcccttgctggccatcagctggggctgccctgaaccttggagtcctctcttccttgtacccggctcccttcatctccctaccagcaatggacatccagtccatctcgctggcttggaaactctctgacttctccttctccttcctcctcatctcttctcctcaaccagataaagttcttacctaccccaacccctagaggttaccattctcccggtgtttattctcattctctgctttttaaaatactttaatcacatactgtgaatcaatatattgatt

SEQ ID NO: 80727 - DNA, 155 bp, Homo sapiens
tggggtgcagttttccaggcaggagcagcaagcatcttgagtcccagaggcgggaactagttggatgcatttgagggacccacaggggctagtctgtctgaaagagctttgggatggaagagggcagggtgctccactattgaagtctagcagat

SEQ ID NO: 80728 - DNA, 281 bp, Homo sapiens
atcttttcaaccctatcaataagatgttatgaaagattggatctcttgtttacaagtagtatagaatcttttttgatctttgactctgtgctgcctatctcatcaatgttgttgctattaatatctgtcctttaacactggatgttgggatcttagtaatgttgctgataataggattttcagcaaaacttccatatcccttgaagatatggtagtttatattactatatcgataacagttttgcctgtggagatttgactagttttaggtgtttggaagc

SEQ ID NO: 80729 - DNA, 326 bp, Homo sapiens
tgtcacttaatgcacagctggggctcaggacacagctttgcacaccctaagtgctcaataaatgctagctcagggcagagctttgcataccctaagtactcaataaatgctagctcagggcagagctttgcataccctaagtactcaataaatgctagctcagggcagagctttgcataccctaagtgctcaataaatgctagctcagggcagagctttgcataccctaagtgctcaataaatgctagctcagggcagagctttgcataccctaagtactcaataaatgctagctcaggacagagctttgcataccctaagtgctc

SEQ ID NO: 80730 - DNA, 368 bp, Homo sapiens
tcacaccttgctcttatctcctaagactttaaatttttcctccatattctttaccatcatctgacattgcatgcagacaccacacacatttcttcattgcttaccatccatactaggagaatcaacccagaagtagctgctccgtgatggatatatgactggcatgtaacagacactcaaatacttgttgactgtatgaatgagttttctttttcaaattctgacttggccatctgaagctatctgttttcctcacaactttctgtcttctgcaactttggtgcagaataattattacccaactactgacgattattttatatagggcagagtcccgtgacgaaactgtagagcgaccatcaacttgg

SEQ ID NO: 80731 - DNA, 345 bp, Homo sapiens
taattatagctaggaaaatcttttccttagaaactaactctaaaagtacttaaatatgtacaattaaagaaaaaatgatacgggctgtgtgactcaaaactaatgcacacacaattactttttaagtaatatggataatttattgaacaataaaaatattttgggatatatgttatttataactaacaacagaagatgtataatagcaactgataacagaataacaaccattcttattgaaagaaattgccatgcaggttacataaactacgtatttggaatgatgactaaaaattttcaggctaagaagattgtttattattcattaagaaagtaaaaaattaa

SEQ ID NO: 80732 - DNA, 421 bp, Homo sapiens
  misc_feature (338)..(338): n is a, c, g, or t
  misc_feature (344)..(344): n is a, c, g, or t
  misc_feature (353)..(353): n is a, c, g, or t
  misc_feature (356)..(356): n is a, c, g, or t
  misc_feature (379)..(379): n is a, c, g, or t
  misc_feature (385)..(385): n is a, c, g, or t
  misc_feature (400)..(400): n is a, c, g, or t
  misc_feature (410)..(410): n is a, c, g, or t
gaaacgcctcccttcccaccaccagaacctgcatacatcacctggaaaactagagatcagcctgccacacacactacccaggagcccagtggtgcacctgcccacctggcccagtgctgccactgccagcaaccaaagaagccacctggaggcccagggattggcccacgcagacaggctatcatcagtgcccacaaacactgcccatggtcccttgtattgacacaccaggtctaccaccacttaccactgatggtgaaggacaagacttcctgggcatccccattcagcaaagtcttcaccacagcctccaattaacaattacagtctgggccaantgtggntgggttcanggntgttatttccaggcattttgagnaggttnaggcggttaggtttnaaggagggtnagggattttga

SEQ ID NO: 80733 - DNA, 375 bp, Homo sapiens
acctcttactccagccactgatgccccaaacagttcatgcaaatttaaccacatccacataggtgcctcttatagtacactctggaaggagaggggttaacacccacaggaccagcctggagcccaacctgggagaggtgtcagtggatatacacatccttctttcagcccggaggagacagttctgcactgcattccatgagctcctcagaaggtctcatgggattgaactgcggttgccacgatggtggtggactcagcccacgtgcttgtctgtctgatgtgttttgcaccctctgccacttggccctgctctctgtggtcactttcccagtaaattgcctgcacacaagcctttgtcccagtctctgcttt

SEQ ID NO: 80734 - DNA, 1609 bp, Homo sapiens
atgtcacttgcacacacagctgcagagtacatgctctcagatgccctgctgcctgaccgcaggggaccccgcctcaaaggactgcgtctggaactgcccctggaccggatagtcaagttcgtagctgtgggctcccccttgttgctgatgtccctggcattcgcccaggagttctcctctgggtctccgatcagctgcttctctcccagtaacttcagcatccggcaggcagcctacgtggacagctcctgctgggactcactgcttcaccataagcaggacgggcctggccaggacaaaatgaaatctctctggccccacaaggccctcccctactccctgctggccctggccttgctcatgtacctgccggtgctgctgtggcagtatgcagctgtgccagccctcagctccgatctgctgttcatcatcagcgaactggacaaatcttataatcgctccatccgcctcgtgcagcacatgctgaagatccggcagaagagttccgacccctatgtgttctggaatgagctggagaaggctcggaaagaacgatactttgaattccctttgctagagcggtacctggcatgtaagcagcgttcacattcgctagtggctacctacctcctgaggaactccctcttgctcatcttcacctccgccacttacctataccttggtcatttccatctggatgtcttcttccaggaagaattcagctgctccatcaagacagggctgctaagtgatgagacccatgtccccaatctgatcacatgcaggctgacatcactgtccattttccagattgttagcctctccagtgtagcaatatacaccatattggttccagtgataatatacaacctcacacggctatgtcggtgggacaaacgacttttatctgtctatgagatgctcccagcttttgatctcctcagcagaaagatgctaggatgtcccatcaatgacctcaatgtgatccttcttttcctccgagctaacatctctgagctcatctcttttagctggctgagtgtcttatgtgtgttgaaggatacaaccacccagaagcacaatattgacacagtagttgattttatgactttattggctggcttagaaccctcaaaacccaaacacctcaccaactcggcatgtgatgaacacccatagttaagaaaccatggagcaagaaagcttgtggaaagtctctctccttcctcataagacatgcacactaatacacatacacaccaaaaaattacacattttaaaactgctaagcttggatttaactgaatcatatatcttttatcatgttatcctaaaagtgagaagacataaccaagacatggaaataaatgtgaaagctggagccgaagagtcaaagagctaaaaaattaagtctagaacattctatgaggatagtataaataaaaagaaatacagtctagacatgctgcaaggaaagaagattctaaagtccgtttatggaggcaattccatatcctttcttgaacgcacattcagcttaccccagagagcaagtgaggcaatctggcaaaagattaataaagatgtaaacccctggaaaacctttggt

SEQ ID NO: 80735 - DNA, 367 bp, Homo sapiens
tgcacccagtcatcttgggtttttatggacgcttcaagacatcagcattccttctcccagggtatagggtgggaccctctcactggaaggtatttagacccacaatcagaaaggagggggaacattagagtcctgccttggaacaggtaaaaagagggcaggaggtcagaggcctgcccctgaggcccaacgcacccaacattataacaaaagactgtaacaggggcttttggggttatgagccaggaaccgtggatgatatccaatatacatcataacaccgcagcaagtttaaaatgttacagctactttggaaaactctttaggattgcttataaagctaaatatacacttactctatgaccaa

SEQ ID NO: 80736 - DNA, 682 bp, Homo sapiens
gaaagaaaagcagagagtgacgcacatcctcacactcccttgattggtgtaagctcagccccttcatgtcagcccactgtgacctcctgggttccagacctgggaagtacttgccacgttctgcaaggactgagtccagcttcagcagtctcatccggaaggacttggtataggcagaggatgagcctgtctctggtcattctaaaagaaggagctgagcccagtgtcccagaattcggaagctcctcctttacagagggactgtaggggttggtgatctcccaggaagcatcggcccagaagaaccccgcgtgcgtgtgtgtgctcttggtgtgtggtggggggaaggagtggcagcaggggtggcgctgggacactgtcagccacgggctctgctttggggacctcgtgtgggaaaggcattgcctgtggtggcccctcaggaggctctaggaggagcgtgccttcattaccttatttcactcggggggcgtctttgccccctaggtgggggcagaaggtgcagaatgggaagcctgccacttagctaaagctcttgcacatgatgcccttggcctggagaggagtgaagtccccaggcagttccctgtggacactggcacgatgccgggtggggcctcaggggtgttgagatgtgcaggtcgggaggaccccgataacg

SEQ ID NO: 80737 - DNA, 491 bp, Homo sapiens
gaaagaaaagcagagagtgacgcacatcctcacactcccttgattggtgtaagctcagccccttcatgtcagcccactgtgacctcctgggttccagacctgggaagtacttgccacgttctgcaaggactgagtccagcttcagcagtctcatccggaaggacttggtataggcagaggatgagcctgtctctggtcattctaaaagaaggagctgagcccagtgtcccagaattcggaagctcctcctttacagagggactgtaggggttggtgatctcccaggaagcatcggcccagaagaaccccgcgtgcgtcagccggtgcgttggcagaagtcatcgccgtaaactgcagtggaagcaagacggggttcaagatgcggcccaaagataagacgcagcacttggtcgagtgttcacagcgtcaagacaaaggacgggccggcgcggtgactcaggcctgtaatcccagcactttgggaggccgag

SEQ ID NO: 80738 - DNA, 454 bp, Homo sapiens
gaaaaagctgaaaatatggtcacctggctggcagaaatgtatccagctattagccacatgtgttggcacgtgcctgtagtcctagctactctagaggctggggcaggaggatcactggagcccaggagttctaggctgcagtgagccatgatcatgccaccgtatcccatccctgggtgacatattgagaccctgtgtctaaaacacacacatgcactcatactcttagctaaaaatcaaagttattttgctaaagaagggaagactggattgggaggttgcagtgagcctagattgcaccactgcactctagcctgggtgacagagcaagactccgtctcaaaaaaaaaaaatcatttctgagtgtgcaatattggccatatattgctaaatgttgaagctaggtgatgatagcaggtttatttattacactagtctctagtctctcctttta

SEQ ID NO: 80739 - DNA, 771 bp, Homo sapiens
  misc_feature (760)..(760): n is a, c, g, or t
  misc_feature (762)..(764): n is a, c, g, or t
  misc_feature (766)..(766): n is a, c, g, or t
  misc_feature (768)..(769): n is a, c, g, or t
ctccatctcaaaaaataaataaataaaataaaataaaaggcaatattggtttttaaaaaggtgtgtgttttaagaatacttgcagttgtgaaatcatttttttctccattgatagttacctctacaatcattcagacattttattaaggccattttacattgtgtcatcctccagcatcactctcttacttgaaataaaataggccttgtaatcactgtgctctattgtctcactttctgggcctacttactggggctttgagtatttcaggcactcttgccccatcccctctgtcaccacccgcaagcctcatcaagcctctaatctggaggtgggtggtggtaaatgagcaagagggaacttgcttagtctcgggatccatctgtaggaacataacgttcttctaatatctgcagatacccagtttctgcaggataaatttcctcatggtctccccatagaagggcctttcctgctgttctcgatgagcagattaatgtagggcacaggtcttaccttctccatgttttccagttctgcctcttgcattgcacaggataaagctttccaggactaggcacagataatttcggaagctaagaaatagctgtgatggtgacaccaacattattctgtggattaatttggttatttagacctatttaaaagaatccattataggtattttatgtaatatttttcttaaatttgtagtcctgtgtgtggctttcatttgggctatgctattattaattaacngnnncnanntt

SEQ ID NO: 80740 - DNA, 415 bp, Homo sapiens
atctgttagaaatgctgcagtagctaaagggacgttccctggctttggtgaagaaataagtaaacaagccagtgtaaagagaaaaccctggttagtgatcagaggccacattctccaacccctacaagttctagcttcgtgtaatgccagaaagagagaggtcaaaagtctgagagaacttttgttatgaaaagtgtttgtttgtatttttaaaattttggataacataatccagtgctttgggtacaaaggtttgagcaatcggcaccattttaataatgcatttagtagtcgcgatgcattaacacttaaagagatagagtctaaaatgcagttcatgtacacatttcacagtctgcctggatatttattaagacacaccttcttttccctagataccttttctcactatttc

SEQ ID NO: 80741 - DNA, 547 bp, Homo sapiens
ctgtggaaatgaaaatgggaagaaaaggtgtaaaaactcctgcttttttttccttagcaaaccttataaaaatatttgacttgtaaaaatgatatgaatgaataattttgataaaaactaaaaataacacagtattgaatgcttactatgtgctaattactgctgttatgttcttggcactttacaagtgtttaattctcacaatcttgaggtggatacagctctgatcactattttacagatgagaaaactgagtcacaaagaatttaagtaacttgcttaaggtcccatagctaattaataccaatatgaatgatgtcattcagtagtatagaatttaagtgcctcatcaatgtcatggacagtaaagtctattccactgttctctgatcccgtgctcatcacattaatatatcatcaaaagttcaggccgggcgcggtggctcacgcctataatcccagcactttgggaggccgagacaggtggatcacaaggtcaggagatcaagaccatcctggctaacatggtaaaactccacctctacta

SEQ ID NO: 80742 - DNA, 597 bp, Homo sapiens
ggatgggccaggctagcctgggaactccggggctcaagggtcacatagctagtcacggcagagctgggggttcaaacccaagggcagggtgggctttatctggtgcttctcaccagcacggcagagattgctgtcttgccatgaggtgctagggtgaaccccatcattcctccttcaggcagtacctgctctgtgcctagctatgtatggggggcacagctgtccttggacgctcctaagctaaacttcccaaggacaagaaatcccgtgcttctgccccctaactactgtactgcaacacagggagcttcgtggtcagctagggaacttctgacgggaaccaaactgtcgggtggggctgctccttctcctcctgcccatctttatgttcagacaggaaatggtcaccaaaaaagccagggagctgagcaagcacctgtcccactactgcccttcctggtgccactggtttctcctttttaaagggtggaagtttctgctgggtgtggtggatcacgcctgtaatcccagcactttgggagcccgaggccaacggatcacctgaggtcaagagttccaaaccagcctggccaatgt

SEQ ID NO: 80743 - DNA, 161 bp, Homo sapiens
cgcctcagcctcctgaagtgctgggattacaggcataagccatcgcgcccagcccatatgtcttcctttttcctaggtctgctcctcacagcagcagcttaaatctttccttctatttctctctaacctcacaggcccttgctaattttgctcctcacttg

SEQ ID NO: 80744 - DNA, 1077 bp, Homo sapiens
ggagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagttcatgaaccaggaggacgttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 80745 - DNA, 393 bp, Homo sapiens
aagcttgggccgggcctgtgccctgagagcagcctggggtcgggctgagagtccgcccagggtgggggaccaggaggggcatggccagaggccctgaccctgaaggatcacttgcttcccatttgcagcagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 80746 - DNA, 421 bp, Homo sapiens
  misc_feature (20)..(20): n is a, c, g, or t
gtgacggcgtttgttaagcncgttggacaaggccaaggagctctgggagaccctgcaccagctggagattgacaagttcgagtttggggagaagctgaaacgccagaaatatgacatcatgaatgtccgggccagagtgcagatgctggccaagttcagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 80747 - DNA, 334 bp, Homo sapiens
agggagggtgccccgggctcacgtgccagccccctaaccacactaacgacctaggcccgccaggcacagcagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 80748 - DNA, 542 bp, Homo sapiens
ggagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagttcatgaaccagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccccacaatcctgtcaggggctccctgacagtcctgggggtggagaggccatcccggggcgtcccccgcgtctgtgtccttgctgccttcatcccctggggcctgtgaataaagctgcagaacccccaaccaaaaaacaaacaacaacccacacaaaa

SEQ ID NO: 80749 - DNA, 1221 bp, Homo sapiens
cgggctggcagagatgcggatgagcccatctttcaccctgcaaggagcccaggcctctttcccggcagcaggctcctgtcttgcggctgagtacatctgatcactgtctctgttccctgttccctcaaacccgcttctcctgctcctggttctccggctctccagtacgaagaagaagaggaagcccaggaggaagctgcagaagtccatgaggaagttcatgaaccaggaggacgttcaagaagaggagaaaccgagacccaaccgcactggcttttctcttgcatgtgtgcttgtgccttttgccacctggaagacaccgcagaggaggacgcggaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 80750 - DNA, 1096 bp, Homo sapiens
ggagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagttcatgaaccaggaggacgttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccccccccttcacagtctgtac

SEQ ID NO: 80751 - DNA, 1077 bp, Homo sapiens
ggagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagttcatgaaccaggaggacgttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcatgaatgtccgggccagagtgcagatgctggccaagttcagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 80752 - DNA, 843 bp, Homo sapiens
ggagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagttcatgaaccaggaggacgttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacgcctctccacccccaggactgtcagggagcccctgacaggattgtgggggctggaggatgtggagtcccacg

SEQ ID NO: 80753 - DNA, 752 bp, Homo sapiens
  misc_feature (114)..(114): n is a, c, g, or t
ggagtgcctgcagccggtgctgtccacagggagctccagcccttctcacactcgacccgcagaaaccacccaccttcaccatgtctgacgaggaagttgaacaggtggaggagnaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 80754 - DNA, 1025 bp, Homo sapiens
  misc_feature (114)..(114): n is a, c, g, or t
ggagtgcctgcagccggtgctgtccacagggagctccagcccttctcacactcgacccgcagaaaccacccaccttcaccatgtctgacgaggaagttgaacaggtggaggagnaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 80755 - DNA, 753 bp, Homo sapiens
ctccctcggaggagccggggacagggctgagcagacccccttctctggctgcaggagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacatcaccacgctcaggagccgcattgaccaggcccagaagcacagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 80756 - DNA, 930 bp, Homo sapiens
ggagtgcctgcagccggtgctgtccacagggagctccagcccttctcacactcgacccgcagaaaccacccaccttcaccatgtctgacgaggaagttgaacaggtggaggagcagtacgaagaagaagaggaagcccaggaggaagctgcagaagtccatgaggaagttcatgaaccaggaggacgttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcggaggaaaaggccagaagggaggaggaggatgccaagaggagggcagaggacgacctgaagaagaagaaagctctgtcttccatgggagccaactacagcagctacctggccaaggctgaccagaagagaggcaagaagcagacagcccgggaaatgaagaagaagattctggctgagagacgcaagccgctcaacatcgatcaccttggtgaagacaaactgagggacaaggccaaggagctctgggagaccctgcaccagctggagattgacaagttcgagtttggggagaagctgaaacgccagaaatatgacagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaaccccc

SEQ ID NO: 80757 - DNA, 516 bp, Homo sapiens
  misc_feature (114)..(114): n is a, c, g, or t
ggagtgcctgcagccggtgctgtccacagggagctccagcccttctcacactcgacccgcagaaaccacccaccttcaccatgtctgacgaggaagttgaacaggtggaggagnaagcccaggaggaagaggaagttcaagaagaggagaaaccgagacccaaactcactgctcctaagatcccagaaggggagaaagtggacttcgatgacatccagaagaagcgtcagaacaaagacctaatggagctccaggccctcatcgacagccactttgaagcccggaagaaggaggaggaggagctggtcgctctcaaagagagaatcgagaagcgccgtgcagagagagcggagcagcagaggattcgtgcagagaaggagagggagcgccagaacagactggcgcggactaggctacatattttctgttcatattaaataattcaataactattctctaggctgggaccggaaccctaattcttctatagtgagttcgttttacaattaactgtcc

SEQ ID NO: 80758 - DNA, 2527 bp, Homo sapiens
gtaagacatgcctttcgccttccaccgtgattatgaggcctccccagccacgtggaactcatacacttaataattcattacctattaagcttcttctcagctgaggtcatgcaaaaatgactcacttgcatatgatactttccttgaggaattaaaccataaactccctccttgcattgtgtattgagggagaagattcctagaagcaacattcatcgtctctcttttcaatgatggacaactctctgctgtgccaaatatactaactttaaccacccactgccaaactcacacctccttgttcaacaagccagttacgggcagtgaatgaatctacgatgctgaacagccccgtgggcatcttctcactgggcactggctagaatgcagttggattagactttcacaattgctttgttttcaagccaggaaggagaaattgaaggcaattcaccacctttctatatccaagatgaaaacacagcactctcctaaacttcagaagtataactcagtgggttagtacttcagatctagcctgaggcaaaattatgatttttccaaaagattttctttttttagcattcttttccttacacgcaggcctttgatcaagctacagttttgaactgattacagcttttgaagcctcagaagatttaaagacccacattgttaacaatggtgttttaggtgtgtggcgtattagaggagtcggctaattctaagtcctcaagtgctcggaaaacaacattaaaaagtctgacatttgaaaagtatggaattaaacatcatggaactggctttaagaaggtatccattcgtggcatgaaaatgtgaagaactttctttctttgcaatgtgagttcaaggaaacgcccaagagtggatgttccatcgtaaatgctctgcccccagcttttcaaaggacacagaaattgcacccagcaaagatgtcctgtcaaaatgatttaaaagaagaaaaagaaagttgctagaggggaactggtactccagatcaaaaaacaattttaagtggtctattttggtggtctgtgttgagacatataacagcccaggctgctgtttttccaagaggttaaatttcaaaaagaggaaacaacagcaaacaggctgccaatttactcaacaatgtcacaactggctggagctctgttcaaagcaaaaccgctgatttacaaattcctggatttactcttaaatattaacacttcttaggaaactttagaccttacatgtcacatttatgactcctaggcagacacaaccctctccaaacacatggtcctcatgacaactctttgccatgtatttcagccccactaagggaagccactgtcaactcaacctgtgatgccaagaagcagcccaggtaccaagggacatagactggagtcaacattagatgcgtttctgtatggtgtagcttggaggaggatgtttacagcacaattccgcaataatatgctgtagcagacagaagtttcccttctatcagacaaagaactagtcagggaaggcaagctggctagaccacggttcagtttttctcatctcctttctgcaagtggaaaatctgctggctggcagtggaaataatagggaaaccacctcagaatgttggagaagaggatgggggaggagttgcagctcaggaatccttcaaagaagacatgtggggagaggaagacagcacacagaagcagggagaagttaagagtatgaaccttaccaacaggtaaaaatgtgtcatattaattttttcaacatcaacaaacacgtcaaaagatggagcactgaaagctgcattttaaacaaatgccccaggtaatgtatactgaaaatgcaatcctgatgtcctaggtggcaggattattgttgttggagaatgctcctgtaaatttcttttccagtcttctctcctcactttccatgcctaaggagtctaagtcccactgcccctgctaattgtccctggttaattagaatggagaatgacccctgaaccaacatgggcccatgagccgcactggtgaattgtcattcagacccaaaggctagtcagtctccctgggcattgagaagcaacagaaagcaagtatgttctttgattacagactaattttctagccccagagttggaactaaaatatgcagataggatagtggcaagagacagacaaatgcctaggcagataaggggtgtccctggagaacctctgacctgcccaggtcattgtgcaccagggttttgcctaaacatgcccatggtgaaaaatttcatcccttaacacatgcagtgtacagtggctcagactaagggcctgcaggcacattggaaagacagggtagagccaccaaaaattcgctccttatgcaggggaagagcctggcctccagcttgtgtgtggtggcctggtattcaatttgtgagatggaaacctgtgtccaggacccctctctttgctgacagctttcctttcgcttaataaattccatcctcctc

SEQ ID NO: 80759 - DNA, 493 bp, Homo sapiens
aaaaaaaatggaacatctttttcagtctttggacctcaaaatacataattcagttactaagtgcgtgcacttttgggcctcacatctggattaaaatcttgcctttgccacatactgaccatgagaacttgggcgagttactgaacctttctgggactcagtttcttcatctgttaaaatgaggttaagagtatgaaccttaccaacaggtaaaaatgtgtcatattaattttttcaacatcaacaaacacgtcaaaagatggagcactgaaagctgcattttaaacaaatgccccaggtccatactgactttatgagccgtaacacttacagcgaaggtctgcagcttcactcctgaagccagcgagaccacggaacccaccgggagaaacgaacaactccagacgcatcactttaagaactgtgacgctcaccgcgaaggtttgcaacttcactcctgagccaccgagaccacgaacccaccggaaggaag

SEQ ID NO: 80760 - DNA, 305 bp, Homo sapiens
caccacattctccacctgggactcccccaggcatccctggggaattcagctcttgggaggctggggtcacagggattctctctaatggggagatggaggcagtggtgtcctgaagggaccctcccccccaacccctcccttttacccagatggaggtggtcctcctgtaggtgcctccgcccctctggagccggccagcaagtgtgtgtgagcctgaggttgtcctccgcatatctgaactaagttaccacttctgtgtgctagatgtagggttaatatcagtagtgataaaaacaaaaaccttg

SEQ ID NO: 80761 - DNA, 176 bp, Homo sapiens
catttttccacaaggggtgaagcaggttgcattgtaaatgttctttcaaaatagtgcaaatgagattcatttattttacaacttcctctcctttagcctctcaattatattcctattttaaatgtctatgttttaaataaactgcactggggcaggaaaagagaagtgtaagaacc

SEQ ID NO: 80762 - DNA, 373 bp, Homo sapiens
gaacaaagtcttatattccttacccttgaccttaaaggaggttgagttgaatgtctcaaattttcctccttgaggggcaaaatgtttttaaactactaggttaaagtcattttgtgaatgtttctcattagctttttactgagggtcagttgccactagtgaagttattccatcctgtctagttttcagttgccatattcctgagaaaaacaattgcctcacaaggaatccagaccctacgtctgctacacacattactttaatccacaaactagaatcaagacccactaatggttttgcatgatggatttgctctttgctttctgtcacgggaggaaaaataacaagaaggcagcccagccagtcatagggg

SEQ ID NO: 80763 - DNA, 583 bp, Homo sapiens
agcgggggtccccggatgtagccctggcgcaagcatctcttcttttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactgggccttggctgtgctgatggccagaagcgagggaacctctccaca

SEQ ID NO: 80764 - DNA, 1264 bp, Homo sapiens
agcgggggtccccggatgtagccctggcgcaagcatctcttcttttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttcccctcagcgcccggaccggctctccgggttggccgaccagatggtggcccggggcaaccttggtgtgtaccaggaaacaagggaacggttggctatgcgtctgaagggtttggggtgtcagaccctaggaccccacaatcccacacccccaccctccctggacatgttcgctgaggagttggcggaggaggaactggagaccccaacccctacccagagaggagaagcagagtcgcggggagatggtctggtggatgtgatgtgggaatataagtgggagaacacgggggatgccgagctgtatgggcccttcaccagcgcccagatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgta

SEQ ID NO: 80765 - DNA, 1312 bp, Homo sapiens
agcgggggtccccggatgtagccctggcgcaagcatctcttcttttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttcccctcagcgcccggaccggctctccgggttggccgaccagatggtggcccggggcaaccttggtgtgtaccaggaaacaagggaacggttggctatgcgtctgaagggtttggggtgtcagaccctaggaccccacaatcccacacccccaccctccctggacatgttcgctgaggagttggcggaggaggaactggagaccccaacccctacccagagaggagaagcagagtcgcggggagatggtctggtggatgtgatgtgggaatataagtgggagaacacgggggatgccgagctgtatgggcccttcaccagcgcccagatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactgggccttggctgtgctgatggccagaagcgagggaacctctccaca

SEQ ID NO: 80766 - DNA, 445 bp, Homo sapiens
atcctcagcttacaatgatgatgggattaagagataaagtaaagacaggcataagaaattataagaggattgattgaggaagtgataaatgtccatgaaatcttcacaatttatgttcagagactgcagtaaagacaggcataagaaattataaaagtattaattttgggaactgataagtgttcatgaaatcttcacaatttatgttcttctgccacagcttcagccggtccctccacttggggtccctgacttcccacaacattcaaatataaaggataaatgaagactttcctgggtaaacaaaagatgagggaattcactaccaccagatgtgtcttacaaaaaatgctacagttcttcaatctggaaagaaaagaattctagcctggcaacaaaaaatgtaaattacacagacaaatttcaaaatactctaatactttat

SEQ ID NO: 80767 - DNA, 326 bp, Homo sapiens
tgacgaggaggaagatgagacagggcctgcgtgaggaggagctggccgtaaagcccaggatggaacccagaggtccgtctcagggcatgttgacatgagagaaagcactggaatctggtctagaggtggatgtgagagggccagacctgtttccattgccaggacaaaaacctgagggagccgtccccatggggcaaagaggactggtgtgggacacggaggccttgcctgtgtccttatggcttcagccagctccttccctttcctcctatggaacgtaagaagtttgggataaatgctttccaagatccaagtcagttttctga

SEQ ID NO: 80768 - DNA, 300 bp, Homo sapiens
cttgaatttgggaggtggaggttgcagtgaaccaagatcacaccactgcactctagcctgggcaacagagtgaaactccatcttgagaaaacaaaaaaccagcttcagctgaactccaagccaacacgcagcagcaactactgctatgtgagtgagtcatcttggacttaccagttcagtgaagcctccaaatgactgcagtcccagccaacatcatgtgaaacagaaaaaccacccagcagagcccaggcaaccctcagaactgtgagagataataatgagtttctgtaccaggccaat

SEQ ID NO: 80769 - DNA, 381 bp, Homo sapiens
tacatgttatatcaagggagggggtataaaagaaatacaaaaattgcagaggtatctggaatgtacctatttgttaattctatttgtcatttcttttgtttcatcttttgagtaataagctgcttggaaaagtttctgttctttagctgattttttagctataaaaatgtatttgaaaagctcataaatttcaggattgaaaagataattgaaagtctaaaaaaaacctaattcattgaagtaataaccaaataattttcaatcttgattcaactgtgattcaaatcttacaccatttgcccacttctatgaattttatgtataaaattttttaagagtcagagtttttttttcttgattaattggatgtatttcacagaa

SEQ ID NO: 80770 - DNA, 361 bp, Homo sapiens
ggccggtgtcgggtagagagactgccagggcacggtggcagggccggtgtggagtagacagcctggggtcaggagagggaggaaggcacatttcccacctatacttgctcagaagtgggtgaagaaagtggggccacagagggaggggctgggagctgcccagagaaagcagatgagcctggcagccaggcttgggttctgggctggaaactggacaatgcgtttagctgaacccacggggggactggggtgggaggctgtccttgctgtggttcatgtgtgaccaggctgggaacagctccccctgctcatttccagggcagacgtgggtctctaaggagcgcaggtccttccccaggtc

SEQ ID NO: 80771 - DNA, 718 bp, Homo sapiens
cgccggaggaggccgtgggaggtgacgtagctgcagggggagctggggaagagccgcgcaggcgccggagagtcttgcggagcatccccctgtgctgagtcccggattcattccttggttttacagacgaggaagctgaggatctgagagctgtacagtagtggctgaggtggggtttgcagtgaaggatgtgacacaccccagatggagctgaatgggcgtgggacctcaggtcttggccacagtggcctgctgtgcattgatcctgctacagagtgtccattatcagccaggcgcggtggctcacgcctgtaatccctgcactttgggaggccgaggtagggcggatacctgaggtcgggagttcaagaccagcatgaccaacgcagagaaaccccgtctctactaaaaatacaaaattagccgggcgtggtggcgcatgcttgtagtcccagctactcgggaggctgaggcaggagaatcgcttgaacccgggaggcagaggttgaggtgagctaagatcgcgccattgcactccagcctggcaacaagagtgaaactctgtctcaaaaaaaaaaaaaaaagtgtgcattatcagggacatggcaagaggacggtggtggaatgctggtggagctggcccagccgtttctggggacggggtcctcagcacagcctgagactgctctggtcccactggccaggctggggctctggg

SEQ ID NO: 80772 - DNA, 467 bp, Homo sapiens
gcgcgtgtgcatgcacccaggagtatatctagattttatgggcctgaggcttacggtttgggcaatatgaatctttctagaactcttcccagggacctgcgcaagtgaagggccccgaagctcactagcttcatggtacatcagcctctgcacatgcgtgtgtttacatgaactgtgtatgtatgcgtgaagatagatggaggaaccaacgaaaaccatggttctttgaccagtagggctcagttccattgaatagtacaatagaaatactagttagtaccagtcactgtgtttcttttctgggaagagagagaagatttattaaaaatcaaatgggttaagaattttctgaaaaatgccctttgaatttcagccattagctaagttagatatacagtgctgtggcgcatgctctttattttcagtaggcaaataaatataacatttttaaatatattctttatccc

SEQ ID NO: 80773 - DNA, 130 bp, Homo sapiens
ttaaaaggactgtgtaaactgtaaagtgctatataagcataagttactaacaattcatcattagattttccattcagacctcctaaggtactcttttccactggcttttgatccgtgcagccgcctccta

SEQ ID NO: 80774 - DNA, 1051 bp, Homo sapiens
  misc_feature (724)..(724): n is a, c, g, or t
caagattccttaccagcagtatgactgttttttccccagtatttgtaggaggccaccagagagacaggattgcaaggttttaaatatgctagtgtcatgaggtcatggatttcctacctgaaacagatagtgtgactgccctgctatagccatgtttggccagtgtaggaattttgagaacagtgaacacttaatactgagatggcatttgccaccccgacaaggaccatacctgccattccattgtagttcgccttgcccagaagttttaaaatttttctttcagcctgggatttcaagtgtactacagcatcctcttcacctatacaagcgtctgttgttttaaaaggaaactgagatggagtctccctatgctacctaggctggtctccaactcctgcactcaagtgttcctcttgcctcagcctcccgtgtcctgagggagaagctggtgccctttatcacacagctaacaacgctcctggccatggatcagagaagttgaaggaaaatacagaggaagttctaacagtggcagacctaattactgcaccatgccaagcaggtaatccagcaggcgctgggaacagcctttggctgacagccagcaaggaaatggggacttcagtgctacaacttcaaggaactaaattttgccaacaaatgtgaataagcttccaagtggattcttccccagagcctccaaataagagcccagcctggntttcatctttgatttcatctctttgagactccaagcagagaagctggtcaggcccccaccaattctccaccatcagacctctgacctaagaactatcaggcacaagaatatgactcctgtaacaatggcgagtgatgattccacatgcttagaggttgggagactctcggaagtcacggtcccagcactttatttcaatttccacttcagtctcggatatccttcaatcaggcaaagctatcttactgagggaaaaactgggtcctcccttcgcacggcaatttagggcgcgggcgcattttccaaaaaaatggggcaaaaagggga

SEQ ID NO: 80775 - DNA, 537 bp, Homo sapiens
gcactagcacaggagaatgagaaatagccagggagataggagaaaatcttcagcatcctttctggaaaatctgaccaaaatttgcacctcctcttcaactgttggtttatatttccttaaaggaggcagattagagagaggtatctttagagggagaatcatgccccttctctatgctgtatagtgcttagtgtccaagagctcttcagttacattcaattaatgtgttaatttacagctgaatcacaaaataatagagtataagggacccaataaatcatctgtatttgtgatttccgaactgaattctttggagcaagtcaaaggacttattttctatctgcattgggaaacctataaagctgtgaccttcctttcctagaagagctaataaaagcaacagcatccaggcagtcaaagatacaggcctcaccccttccttctaagaaacggttgtgattttcatcagacctcaaacctttcagaaagttccaggggcttggatctagtcaagaatatctacagggcagaggggcc

SEQ ID NO: 80776 - DNA, 1691 bp, Homo sapiens
ctaagatagtatgagaaagttctgatcttgacagttcacgtaacattcaatcaattataccattgctctatctctaaagttttctttttctccttttctcagtgtcttaccaagaatgaaaggcaacctatgtaaaaactatgggctttctagtataaataaaaactactcatctccagaaaataaacaatgactgctaagatgattgaaaaaagaaaggagaagaaagtagcttgtaaaagcgtgtgaaatgcattcacgttggaatctcctacaggcacttcaggtcaaagactaccgatgtccagatcataatgcgaggacagtttgagcccagtgctctctgactgaggtagaacccccgggaaggtgaagagggcagccgtctgcgaaacagcccagcatttaagaatgggcagcacctggccaggtgcatttgagaactaggaatgtggcaacaataacatttatttatttggatgaagagaagaagatgtattggattccctgaaacaatcattgacctgcctgaatcccaactgttgcactgactccactaattcaccaatccacttgagctgggaggagagcccatgcacagaagtttatggataaacagacctgaacgtctagcatgatgtcaaatttatatggccacagaactacaaaaggaaataactataacctcactgaccacagtgctgctgacacttggacaacatgggtttgagcttcatgggtccacttagacaataattttttcactaactatattggaaatgtttttggaaatttataacagtttgaaaaatattgtagaccaacatgtagcctagaaatattaaaacattaagaagcaagtatggcatgaatacatagaatatatgtagatactattctattttatcatttactactataaatatatgcaaatctattaaatgaggttaacatttatcaaagcatgtggtcacaaactcttatagtttgtacatggcaccatttacagacaaggaaatagaagccaatgtaaaaatgcagtattaagtcataaccgcataaaagtaactgtggcacatactgcactaccatgataatttcacaggcacctcccactgctattgtggtgagcccacgtgttgtgagcttccgcataaagccctgcaattctgatcattgccacgtgggcagtttgtgtctctagttagttgtgtactgtagtaaaaagtgatctcgcagttcttgcataatttccgtgtttagtgcgatatggtaaacattgaatagcaccatgaaacccacacgaagggccactggtgatgttggaaggctcccaagaagcagagaaaattcatgacattacaaaatcagtcaaatttcttcatatgcactgtagattgaggtctgcagctggggtttcccattgttttaagataaatgaatcagcctaaagatcattgtaaaaaaagaaaaagatattggagaggctataactgcagctatgccagcaacagcagtagttacatttctgaagagacaaaatttgtcagtgggttttcaagagctcaagggtaacaccctaacccccacgttgttcaagggtcaactgtattgcagtcaaaaacagaaatttaaaaaaaaaattccttcaaaaaaataaaattgtattacacacttgctaatccaatttt

SEQ ID NO: 80777 - DNA, 446 bp, Homo sapiens
ctaagatagtatgagaaagttctgatcttgacagttcacgtaacattcaatcaattataccattgctctatctctaaagttttctttttctccttttctcagtgtcttaccaagaatgaaaggcaacctatgtaaaaactatgggctttctagtataaataaaaactactcatctccagaaaataaacaatgactgctaagatgattgaaaaaagaaaggagaagaaagtagcttgtaaaagcgtgtgaaatgcattcacgttggaatctcctacaggcacttcaggtcttcagactgtaaacattttaagtgtgattgctgtgaatgaaggaaacccagagccatcatgacaagcctaaactcaaaggggactgatttcttctacactgaatgtttcattagtgacagggcccagataataaagaattgtgctcacttcctgtga

SEQ ID NO: 80778 - DNA, 142 bp, Homo sapiens
gaatccatttgctgaatttggaaggttctcattatgagcccattctaagtatgtgtcatatgaggtcaccctgtatttggatcagaaggtatagtcagagctcacatcccaggcccaaacagcccaggacagcagagcaaga

SEQ ID NO: 80779 - DNA, 525 bp, Homo sapiens
taattggtccaatttgtcttctggttcccaaagaagatcaggtagaatgaccacttgaaattagccaaaaaacctcatctctaattacaggagcaattgggcatttagtgatctatccccagcattagttcacaaaaggacccttctatgtgtgctgcacaataagatatgatgtaacaagcttggattccatagtacatagtattcaagaaggactacataaagcaagttgctgagaaggggttaacagcggtgcaggtattactttgaagcatatcattccaataattgatatgagcattagaggattctctctctttctctccctctagcctaactaattttcaaaaggcatcaacccttaagataccatcaattttcttgccctggtatttgaaatggggtacctccacagcttatcagtacaggttttctaaagtttccatggtattcaaccaccaagtaaaaatttaggagaatacagttgtcaaaaccattgtcaccctaataaaaatatatgctaaa

SEQ ID NO: 80780 - DNA, 299 bp, Homo sapiens
cctggctgttgagatgcccgggccctgtggccgggctgcaggtgggtcacctgactgttgaggtgcccgggccctgtggctgggctgcgggcgggtcacctggatgttgaggtgcctgggccctgtggctgggctgcaggcgggtcactcggatgttgatgtgcccgggccctgtggctgggctgtgggcgggtcacccggctgttgaggttttgctacacatcagttacagcaaaggtccctgcggggaggcacacgtcagcagggctggggaaggaagggaggcttgctagagaccc

SEQ ID NO: 80781 - DNA, 389 bp, Homo sapiens
acctgttcccccctctaaatctaggcctatatattcagttctgagacttctcttctctctctctctctcatacacacacacacatacacacacacacacaccattttttctacacaagaatttatgactcagggaaataatctgatgttgattttttccctgcttgcctctaaaaatgcagtgctacctaatttcattgaattctatgaaattttaaaaataaacagatattgtgagcatgttgaaatatttgtctttgaaaaatgacatttcaccttaaagggggttttgcttgtgatacaaagttgatttaatggtcttagtatcaaaatacatgtttgtttatagatgctaagaattgtcagtttaggattttataaggagatatt

SEQ ID NO: 80782 - DNA, 759 bp, Homo sapiens
ctcgtgccgcaggagaggggtttagagcacagcctccctctccagggtcagctgaagcgggagctgttgggggctccttccctcgcagcagtgaccactccaaggaccacggcctggacatgagcggcagcggtgagctgggagctgctggcctggagtctagatgaatataggcagcagccaaaggccacagtcacgacaaacctacacactctcaccactgtcatctcatattgtcctaaaatttccagccagtgcaaaaaaacatgaaaaagaaaaaatacagccattggaaaagaggaaaagtaattgttattagctgatgatgtgaatgtcttcctgaaaaccttaagagaaccaactggaaaacaaccagaaatgagagcatggagttaggcaaccgccgatctgctttctgtcactttgggcgagtttttcccgtcctgggatttcatatctctggaatcctgcagtacgtagccctctgtctggcttcctcgctccgtgtaatgttcttgagattcatccatgcagctgtgtatacctgcagtgattgtttctcttgttgattgctgagaagggttccatcgtatgccttttccagtttatttgttcatctgttgttagacatttgagttatttccagcttgggactcttatgaacaaaactgctataaacatgcatattcaagtctttgtggatatgtgctttcttttgtcctggataaatgtctccacgtgggcttcctgggtctcacg

SEQ ID NO: 80783 - DNA, 736 bp, Homo sapiens
ctcgtgccgcaggagaggggtttagagcacagcctccctctccagggtcagctgaagcgggagctgttgggggctccttccctcgcagcagtgaccactccaaggaccacggcctggacatgagcggcagcggagtctagatgaatataggcagcagccaaaggccacagtcacgacaaacctacacactctcaccactgtcatctcatattgtcctaaaatttccagccagtgcaaaaaaacatgaaaaagaaaaaatacagccattggaaaagaggaaaagtaattgttattagctgatgatgtgaatgtcttcctgaaaaccttaagagaaccaactggaaaacaaccagaaatgagagcatggagttaggcaaccgccgatctgctttctgtcactttgggcgagtttttcccgtcctgggatttcatatctctggaatcctgcagtacgtagccctctgtctggcttcctcgctccgtgtaatgttcttgagattcatccatgcagctgtgtatacctgcagtgattgtttctcttgttgattgctgagaagggttccatcgtatgccttttccagtttatttgttcatctgttgttagacatttgagttatttccagcttgggactcttatgaacaaaactgctataaacatgcatattcaagtctttgtggatatgtgctttcttttgtcctggataaatgtctccacgtgggcttcctgggtctcacg

SEQ ID NO: 80784 - DNA, 323 bp, Homo sapiens
ttttttttttcattgaaattagatgatattagataactctgagaactggacattcaggctccaaggttcctcacccaaaaatgactcccaaaacacagagtggaactattccaagggagaagcctctgccactgcttctgggcacacacacagaggcatgcactactgacactgaatggcactggtccctgaacttgcacatcaaaactatcacctcttttttgctactccttgccaatacaaccaacagcaaccaatatacggagctcacactatgctttctaacttctgtccctggtcccataatcattaagcacataaac

SEQ ID NO: 80785 - DNA, 116 bp, Homo sapiens
tagtttgtagaaaattctttcagctatggtaaatgtaaaaggcagggttcgcttttcactgatgtctagtcaacattttcttcttccaggatattcccccttgctgtgactatttt

SEQ ID NO: 80786 - DNA, 337 bp, Homo sapiens
taaaaagagaggtttaccttggaaattatgagagtagaagatagaagaaatgagaaggggtgaatggaggaaagaagaaaagttatggacagtgataagcttagatactttatgtgtgtgttagttttctcaccttagggccaggtaagtaagctgagacacatgtgccacatacttatggtgcctaggaagaatattatttttctaaatgagctgaatttttaaaaatagaaaatggactccagtaggccttaatctagacataaacaggtgtgttgtacatggtactttgctaccttcaaagataaaaaaataatttaaatgcattgtaaaatgg

SEQ ID NO: 80787 - DNA, 3605 bp, Homo sapiens
aacgattattatggaagataaaatatatttttaattacttcaacagaaggaattatttaaacgcaatatttatttgcttctggaggacatttatgtaaataaaatttaggtagtgttcatcaaactgtgaaaatctgtggagacgcgtggtggcgctgcaggataatatcaagaaaaaaattaccctggaggatgttgtagaccctgttatccagtacacgcggagaactgggaagacagaaagaacaatcctttaagggagaacctagaagccattcaacaaggttaaaatcttcaggcttccgaggatttggtagacagatcagaggcacgtttcccacaactgcgaagaggcgctgaggcaattctgcaagaagattttggggttttggaaaagaagctatggaaaacggaggggcaggcactctgcagataaggcaagtcctgcttttctttgttttgctgggaatgtctcaggcgggctctgaaactgggaactttttggtgatggaggaattgcagagcgggagctttgtaggaaatttggcaaagaccctgggactcgaggtgagtgagctgtcttcgcggggggctcgggtggtttctaatgataacaaagagtgtttgcagctggacacaaacactggggatttgctcctgagagaaatgctagacagggaggagctctgtggctccaatgagccttgtgtgctgtatttccaagtgttaatgaaaaaccccacgcagtttttacaaattgagctccaggtcagggatataaatgatcactctcccgtcttcttggaaaaagaaatgctcttagaaatcccagagaacagtcctgttggtgctgtgttcttgcttgaaagtgcaaaggatttagatgtaggaatcaatgctgtaaaaagctacacaataaatccgaactctcatttccacgttaaaataagagtcaatccagacaataggaaataccctgagttagttctggacaaggcgctggattatgaagagcgcccggagctcagtttcatcctcactgctctggatggcgggtcccctcccaggtctggaactgccttggtcagggtggtggttgtagatattaatgacaactcccctgagtttgagcaggctttttatgaggtgaagattctggagaatagcatccttggctccctggttgtgaccgtctcagcctgggatttagactctggaacaaacagtgaactatcctataccttttcccatgcctcagaagatattcgcaagacatttgaaattaatcaaaagtctggtgacattactttaacagcacctttggattttgaagcaattgagtcatactcaataatcattcaagccacagatgggggaggactttttggaaaatctacagtcagaattcaggtgatggatgtaaacgacaacgctcctgaaatcactgtgtcatcaattaccagtccaatcccagaaaacactccagagactgtggttatggttttcaggatacgagacagagactctggggacaacggaaagatggtttgttctatcccggaggacatcccattcgtgctaaaatcttcggtaaataattactacactttggaaacagagagaccgctggacagagagagcagagccgagtacaacatcaccatcaccgtcaccgacttggggacccccaggctaaaaaccgagcacaacataaccgtgctggtctccgacgtcaatgacaacgcccccgccttcacccaaacttcctacgccctgttcgtccgcgagaacaacagccccgccctgcacatcggcagcatcagcgccacagacagagactcgggcaccaacgcccaggtcaactactcgctgctgccgtcccaggacccgcacctgcccctcgcctccctggtctccatcaacgcggacaacggccacctgtttgccctcaggtcgctggactacgaggccctgcaggggttccagttccgcgtgggcgccacagaccacggctccccggctttgagcagcgaggcgctggtgcgcgtgctggtgctggacgccaacgacaactcgcccttcgtgctgtacccgctgcagaacggctccgcgccctgcaccgagctggtgccctgggcggccgagccgggctacctggtgaccaaggtggtggcggtggacggtgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgcctctcccggaggcggccccggcccaggcccaggccgactcgctcactgtctacctggtggtggcgttggcctcagtgtcgtcgctcttcctcttctcggtgctcctgttcgtggcggtgcggctgtgcaggaggagcagggcggccccggtcggtcgctgctcggtgcctgagggcccctttccaggacatctggtggacgtgagtggcaccgggaccctgtcccagagctaccactatgaggtgtgtgtgactggaggctccaggtcaaataagttcaaatttctgaaaccaattatccccaacttcctaccccagagcacaggtagtgaagtcgaagaaaatcccccatttcagaataatttgggtttctgataaagaatgaaaaataaaacctgtgtttatgaatacatttataattaggaacttatcgtgaggtgcctgtaaagtagtatttttgatcacttcaaatacatactcttcaagtcaagaaataaatttctttacatagaaaaggatacagatttagtaccaagaacacttcacaaagcaggaaatgtgcatgtgtaatggtttatgtcaaacaattatgcttaatataaagtctattaagtggtaagtcttgtttgagatattttaaattgctttccattgttttcaatatttactgtgacttttgttttctgagttgattagaatgctgttcgagtatacctaccctagtttcagaagcatagattgtagtgtacctttttaaactttatttttttaaaaaaagttgttttatgaatcatacactattttcacacttttaatctcagaagaaacatatgtgacatggtattttagtaatgaccaaatagacggtcttagagattcagtaagttcactaaggtccactaactaataagtgacaaaactgagcatccatcctagatctgcctgactctaagtcagtgactttgctcccattccatactgtttttgtcattggatatcacctggcaagtttctgcctaactaaagagaagaaaagtttttatcgtattcatactactgttcaatctttatttagaaataaactttatctatgatttcattttcttataaaccagtaatcttgcttttctgggtaaattttcagctattattactaatgctctgatctgcccaaatcttaagtaaaaaac

SEQ ID NO: 80788 - DNA, 374 bp, Homo sapiens
tattgcttttctcttcatgtcccatagttaattagtcctactcctgctgattcttctttaaaagagcttttccaaaatttaagagccttaaaaaggttcaatgtctttgacctaatatttccatttgcaggattccacctagtctaagaaaatctgaaatgcatacaaagatattcactgaagtaataccatgccagaaaactggaaacatctgtctagcaatagggaaatatttaagcaaataaaacaaattagaatgttagtcattaataattagttatgaagtttttaaagacatgaaaaatatacatatatttttttgagtcagagtctcattcggtcgcccaggttggagtgcaatggcgccatctctg

SEQ ID NO: 80789 - DNA, 931 bp, Homo sapiens
cggaaaccgagacggcctggatggaaaactctttcaaggaagaccccagggccctgaacggaattccggatattttctctacaacgtactacacctgccttttcccagactttgatccacacaactattctctttcttggtctgaattttggcaaacgacaagcaaggcatagagatcgcttcaactagctacccgcggctggcccagacgttagggttttaggccgccgttagactttggccctgcaggtcaaaatcagctactctaggcctgtcttctcggaggccagtagcagcacctggtcctctccgcgcggcttctcccgccgggtacgcaaccctgcacccctttcctgtgacctgcagcgaagctcggcggcagaccgggtattcaactggccaggagttctcgaggcgcaggtgcgggtgtgcagggacgcgcgcggtgagtttgcagttcctgccggctccggcaacatcccgggtcagtccgaactccgaaggcgccaaggcagggagggaccagtaggtgaagggcagccgccctcttgcgccctgtttcagtcctccagtcgctgttgaatggagtttccgtctccagtctcagccaaagcaggcaaggcggacaacctcggcctggcaaccagtgagtatgcagtcccttctccaccccgttgggcacttgaacttgtgccgtcggattgtttctccccaagctttctgtgaattccaagaatgcaactgataactatttaaaaactgcccttaacttgaagaaagaatactttaaagtcttagcaaaggaaatgggtgcatatgtctacaaaaagaattgtactagaatatagcagctttgttcacgagagccagaattggaaataacccagtcatccacacagaaataacagtcatcaataacaccaaaataata

SEQ ID NO: 80790 - DNA, 468 bp, Homo sapiens
tatatgttaatgtacaatatatagggttctgtttgtaataaatttgcctcataaaatgcatctcagtttttttttgagcaaatactagaaaatcaaagctcagttttttttttatctcaaattccaaattatacacacacctagaaactcctgttagatgctaacatttctctatagtcaagataccttaaactttaagcattaaaaggctataatctagcaactcaacttcttcccctttcctgtgtggattaaaataatttcttttggggtttatgtcttttaaacatcaaattgtccagttctacacagccatttaagtcagttcttttaactaaaatactctgattatattgtgtttttctgggagtgagaatttttgttcagttttttttttttttctgtttttaagagatggggtcactatgttacagcccaggttagtctcaaactcctgggctcaagtga

SEQ ID NO: 80791 - DNA, 194 bp, Homo sapiens
acggcatttctccattgccttttggctgtaatggtgttgttgagcagctacaggctactctagtcctcattctgttgtcagtgtcccccaccctccaacaccccagaagtttttaggctcatctctttatcctggtgttcatgatatgctctggtcaggcaaatcctctaagaggatttgtatttgcttgtacc

SEQ ID NO: 80792 - DNA, 365 bp, Homo sapiens
aaaaaaaaagaatgcttggctgggcacagtggctcatgcctgtaatccctgcactttgggaggccgaggcaggtggatcacctgaggtcaggagttcgagaccagcctggccaatatggtgaaaccccatctctactaaaaatacaaaaattagctgtgtgtgatggcacgtgcctgtaattccagctacttgggaggctcaggcaggagaatcacttgaacccagaaggcagaggttgcagtgagcagagattgcgccactgcactgcagcctgggcaacagagcaagactcgggctaaaaaaaaaagctgaagtgagtccttcaggctaaaatgaaaagatacaagataataactcagagcta

SEQ ID NO: 80793 - DNA, 256 bp, Homo sapiens
gaagatgaagttagagggagagagaaagtggggagccagatcatagagggctttgcaggtcacttgtaaggactttagctttctaacttttgtaaggacttcaacttctactcacagtgaaattgtgaaattccagaaccaaaaagaagatcctggtaaaagagaaactttcagcaaaatatatttaacattttatttgagtgaagaacaattcatccatcaggcagcactgagaaccagaagacattcagagagc

SEQ ID NO: 80794 - DNA, 458 bp, Homo sapiens
aaccaatctaaaacaagcctttgattgatagcatcccagagtacctcgaagaagcaaacacaaatgctgtcaggagggactcacccttaaactaggagttacaagattttaacagtgtaagactaccaaatgtaagctcatgatttcaaatcccagaaacatacagggaaacaagagccatgaatgggaaacaggagaaaccacaatagcagaactagacttccaaaaaccttaagacagtgatttctcagataaagtaaactatgtaaatccccaaaacatttttttttatttcttactataatttttttaattttattattattatactttaagttttggggtacatgtgcacaacgtgcaggtttgttgcatatgtatacatgtgccatgttggtgtgctgcacccagtaactcgtcatttaacattaggtatatctcctaatgctatccctccc

SEQ ID NO: 80795 - DNA, 321 bp, Homo sapiens
catgttggccaggctggtctggaactcccgacctcaggtgatcctcccgcctaggcctcccaaagtgctgggattacaagcatgagccaccgcacgggtggcccacatggcaatttaaagtcccttccaggcctgatatccaagacaaagttaatccaggcagggttcttggagaaggcagaagagaggaagaggaagggcttctatgaggggctgggatggggcagacctgaggctctggagccggctgaatccttgggcaagctgctgctagacaccagcccccaccccagggggtgtagaggcttaggtcctgggggt

SEQ ID NO: 80796 - DNA, 1954 bp, Homo sapiens
acagagtaagactccgtctcacaaataataataataataatttttccatgctatcatcaaatagctaagttttgtttctctgagtttagacttgaatcttaggcttaaagggcacgtcagttgttgtttagatcaactcccagcacctgaataaatgccttccatgcaatcctgaacacaatctatttttctctatttttctgtacaaaaagagacaaaatggtccattttttagtacgaagtgttgctcttgactaagagtatgttaatgaagctctttgtcctttttcaaagcttacattctcaaaccataaccctcatatttgcttaatgttagtggaacaactcaaaggtatactgtgcctgtcacaatacaagaaagatgctttcagaaacaaaaatggttcttatctaaataagaagaaagctgtctccatttccataaaaaggattgcatccttgccagagaagataatagagtttacatacacagtcaagaagagtgtgggataaagtcatttttattttcacaaataaaaagtgttttggtaactggaaggcagcccatataaaacaagctttcatagtcaccatttcctcaagctcttcccagtgagagatgggaaacacttgaaactgctcactggagaaaaaaggatgatgagggtgactttactgtttatttgaggggtgagtatgaggaggaagtgattctaaacttcaaacgtgatgaaatataatttcttcatcatgccttgatcaaatataagatcacttcatagagttgtttctcttatatgcccaccattttttcatatatatatgatttgattttatatacacatatgtatacatattatatataaatatatatgtgtatacatatatgtgtgtatatctatgaatcaaacatactgtttctgttggagatggttcagaattataaagattatctgaatctttatctgtgagcagtctccaagtaagaagttgaaaggtgaagcctttgactgctgtcatgtctgaggtcattccaaggacatgggagactgctgtccatggttggatcctcttaacatcagcagagttctgtcaagttacttagctttcactggggcagctctagcattccattaattcaaaatgttgttccttaatataagcctctaacatttaaaataaaaattttaaatgtatccattaagggaataattacatattgaattcctaagaaataagaattatttgggtggttttttctagatagaataaacacaagagctggactatattaactgttgtatacacttttttaactggcattttcagttacttgtgatttttccaggaaaaataaaaatgaattaaagtggacagcggacttctaattggtttggtctttgattacatttgaccatcaacaatgatgtaagccttggatagaatgtgcccctcagtgccccacttaaatttcttggtaaaccttgtggtgtatacacttcattgtgctttttggaatgactctaaaagcccataaactaatgctttgcaaagcctaaataaaaatgtttgcagcctgtattagaaacacttccttttatgatctgaatgtaaaatagaggttgttggtttttttttttaacaaattacacatttgtgatctttgcaatatatgtgtaaccaaaaccgaaaattgcaaagaaattgcttggagctgattaacttacatgctgctatttagaaattctactagagattattaatgcacaaatattttcagagaagttgccttatttacaggacaacactacctatatttaattatcatcttaaggctaagaagaaataagggcagaggtattttccataaagccattatattatgttagtttttattaattcaattctatttacaaagactttaaggcaggccttactttctttaaaaaaaaaa

SEQ ID NO: 80797 - DNA, 846 bp, Homo sapiens
agacctctgtctctttggaccagttcctccatttatttctgtggccactttctaacaccaagtgctttatgttgaatcctcattttggcatatttttcagaacttccttacacagaaaaacctgaagtttcacaaattaattattctaaattatttgtgagataaaaataatgcaaaggagtagtctacaattgtttgacaattagaaatgcttatatgataaacatttgttaaggacagactataactaaagcacctgaaattctaattttatttaatattccaaaaattatttacaggtcagcaaacttttctgtgaaagcccagatagtaaatattttagtcaactctgacattttaccctgaaagcagccacagacaatacagaaacaaaagagaatggcagtgttctaataaatctttatttatggacatcaccatttgaattgcttataattttcgtatgtcatgaaataattctatttattcttttcaatcatttgaaaatgtaaaaactgtttttagcttgtgggctatacagaaacaggcagcaggtttgatttggcctaagatgactccatacttgaagcttattttaaatatgtaaaataacattatcaatatgtaacaggtcctataagcttcagttatacaaaggacttaaaaagtactatgtaatggatactcagcacacaaaaataaagctccattaaaacataagtctgacaaaaatttaataaataatatactgttcttagttactgagagtttttgttttctacttgggaacaggaatggacttgagaggggtggtgggttaggtctattagcatggcttagtaaaac

SEQ ID NO: 80798 - DNA, 552 bp, Homo sapiens
aaaaaaaaaaaaaaaaagaatgtgcattaagcacatatataagtgaagaacatattttttgtttaaaacccattcacctttgctcatgtttactaatgtcttggcccctgatggcctttcattctgtagcctgtatagagcagggatcagcaaaatggggctcacaggccaaatgtggcccaacccctttttttgtaaatgaagctgtattgggacgcagccatgttcacttattcgcattttgtttatggctactttcatattacaataggacacttcaggagctgcaatagagactctgtatctctcaaagccaaaaatatttatcatttggcccttcgtaagaaaaagtttgctgactttgattttcagcgagggcacccagagagcttggaagtgattactcctgggctcataacatgaaaaaaagctgaacagaatgaaaatctatgacttttctggattcatcagaggattgaggtcacagggcaaaccactggtctgcaatctggagagacaggtcaacacagagaatgagagccaaggtcagct

SEQ ID NO: 80799 - DNA, 212 bp, Homo sapiens
ggccttggcccttcaatggcttacagtgtgacctcaggtaaatcatttaaccgatctgagcctcagcgtccccattgtcacatgagagcaatgggctgaatggtttcaaacaggctcactatttcatgttctcatctctgggcgccatgtccagaacttcttcctaccatgaaaaggtgccatgcttgtcatgaagcatgccgggaacccct

SEQ ID NO: 80800 - DNA, 474 bp, Homo sapiens
ccacagaggagatgctcttcacgaagtgagactcaggatgaatctttctcattcagacagccactctggcttaaagatatgtacaaacctctcagtgccacaagagtaaataaccaggcatggaagctgcacaagaagtcatctaatgaggatgagatccccatctgatgaggacagcgaaaccccaacagagaagggggaggagagtgaagccctgccacgggaggagaacacagagtgaccccagcccacctcaggcgtcctgcaaaaatacttagcgtaaacaacaagggccatcagaaagaaaagcaggactgaagccagcggcccacgcatccacagaggcagccggcggaggaagcacagggccgtcgttccctcctttgtttcccagtctaattaatcacccagacctgaaaacatatcctcagggggtggagattttacaattaaataccattgttcttggtgaaa

SEQ ID NO: 80801 - DNA, 4263 bp, Homo sapiens
gtgcccagcctgcctggagaaaagcgtctgctcctagccaagatctcctcatcacaaaagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactga

SEQ ID NO: 80802 - DNA, 4229 bp, Homo sapiens
ggaaaagagggcacccagcccttccccctccctcatcctcccatcccagtaaaccctgccaaattggaatcctggacttaatttaggagaaaggccctgtaaccaagatactgactgaacatggctggcggactcaggctggggtctgcagtgcagcattaatgggccgctgacatgaatatggagtagttttctctagcaaagagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactga

SEQ ID NO: 80803 - DNA, 4814 bp, Homo sapiens
tttgtgtctatttttttaaacattacatttgtcataatcattcatattgttgtgtgtagttgtagtttgttcattattattgctataaagaatttcattttatgaataaaatgcaatgtattcattcattatagtgttcacgaacattttgactgtttctattttgggtttatgaatattctagtaaatattttttagtaaattctcacttgttgttaagtacaatttatagaggataggaagtggcaacaacaatgagtgttccccttttgcctatgggaaaagagaggcaaagggagaattagtgttagtggcccaataaggcttctggtgcctgtttcctgattcttgggacagagcacattcttcctgctacaccattgaaaaaactggatccagatctctcttctgaaggaactagtaatacatgattagcagcacgggtgactttttaactatgcccttcaaaatccaatcattgaaaacttattgaattaaaaggaatcaggtaagttaaagaaactgggctaaatgggttttgctttctcagtcactcaacctggctcttgcctcttcagttttctggacacgtagaaagcccctttgttctctttcttctacaccagcagtttttatttgcctgtttcccagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactga

SEQ ID NO: 80804 - DNA, 4409 bp, Homo sapiens
ggaaaagagggcacccagcccttccccctccctcatcctcccatcccagtaaaccctgccaaattggaatcctggacttaatttaggagaaaggccctgtaaccaagatactgactgaacatggctggcggactcaggctggggtctgcagtgcagcattaatgggccgctgacatgaatatggagtagttttctctagcaaagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactga

SEQ ID NO: 80805 - DNA, 5743 bp, Homo sapiens
gtgcccagcctgcctggagaaaagcgtctgctcctagccaagatctcctcatcacaaaagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactgaaagactgaatttggtgatttttgacagtctctgtggcttctgtcactgtgattgaaacagaaaatacttagggggtgagtgagtatagtatgtatttgtctagcctttgtagaacctacaagtttttgttttagagatgaggaagctgttccagaggaagcatcaaagagtgctgggtaccaccctagaaaaggagctgtcgcataaatgacaaaaattttctgagtgtcaagaaaatttgccagagggaaatagaagtctgagacgagactcaaacctgtccagtgggccaggggaagtaggaccatatcttatggggcctttttggcagtggtggtgtgaaaggtctagttgcaactttgggggcttccttataggatggagtcattctttctggtattttacagcaatattcctttgttacatgcaaatttgagccaaatattggttagagagcacagataagtgataaattttagattgggtaagatggcccaccccactgcaatatccataatattgtaccacatggcaagtggagaacagaagaggtatcaaggagagaaaagatgataactatgtactgttttacactttaaaaagcattttaattcttgattgcgtttggattacctcagggcaagtcattttacatttgagtaatgttatccatttatacatttgagtgaacaaaagcttatggacattaagtaacttcatccaagatccctcaggtagaagttgagcagggattcatgtattcatctgtttgactccaaatacctatttcatcctcatatatcatggaaacatccactaatctccatccaccttacccatattgattccaacttttctgtctgtccagcaatctgtctgtctaggtagcaatctcttgaagataaaatgtagaaactcacagagctggtgttcagttacgatataagtttggaggagaaaacacaatccagaagctatgattcctcttgtttttccatggtcaacgggtttctggagagctttactgagaatctcagaaataaagtgtgggtggaagggggatttagatggctagttatccaagagttagtgtttaggccattgcagaatcaatgatttaacagcagcagaactgttttggcctgcagttaacatgaatgttaatgaagaccaagtacatgctaggaattccagtcaattaatggttataatttacatgcaactaggaggttcttagcttggtctcagttataactctaagagactaggagaggtagatgagatggaatgcatttcttcttattttgtaatcctgctccaggtcaaggaatagaaactcagagcccatgtatttaagaaagaaatgtatttttgtggtaagtttgctccaagtagggatacaagtatctatttttgacaatcaagtgacattgccatctattcagttgctcaagctggaaattatcagtgtcaacacatc

SEQ ID NO: 80806 - DNA, 1020 bp, Homo sapiens
cctcttgtcttttttccccccaaccagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactga

SEQ ID NO: 80807 - DNA, 394 bp, Homo sapiens
gaaggcatcacaatgggaggtgcatgtactctgggccttgaaagctgagtcacattatgccatcagataagggatatgatgatggagagggcattgcaggcagaggaaacagcacaaaaaaacactaggttgtaaaaatgcttggtaggctaagagatcaataaatagtttagcctagataaagcataggtcagatagtgcatcttaactgagtcccaagataattgttagaatgaattcaaataacatagtggggtacttataaatgtaagatatcatgaggaaatgctgagaggcacagtgggcttgtatgagaagctggctccctgcggagtactgctacccagaaacaactccatctctttctctctctcccacttcctcccttcctcag

SEQ ID NO: 80808 - DNA, 2175 bp, Homo sapiens
cggccgccattgtccggcgttcggcgagtcgggtggtccctttggctggagtgcctctctggtctggggatcacctcaggcgctgtccttcactgggcgatccagcatggaccccgaggacgaaggggtagcgggagtgatgtctgtggggccgccggcggcccggcttcaggaaccagtgaccttccgggatgtggctgtggactttacccaggaggaatgggggcagctggaccctacccagaggatcctctaccgtgacgtgatgctggagacctttggtcacctgctctccataggtcctgagcttccgaagcctgaagtcatctcccagctggagcaagggaccgagctatgggtggctgagagaggaaccacccagggctgccatccagcctgggagcctcgatctgaaagccaagcatcacgcaaggaagagggcctgcctgaagaggagccatcccatgtcacgggaagggaaggattcccgacagatgctccttatcccaccacgttagggaaagacagggagtgtcagagccagagtctggcactcaaggagcagaataacttgaagcagttggaatttggcctcaaggaagcaccagttcaagatcaaggctacaaaactctcagactcagggaaaactgcgtcctgagttcaagcccaaatccattcccagagatctctagaggggagtatttgtatacttacgactcacagattacagactcagaacataactccagcttagtcagtcagcagacaggctccccaggaaaacagcccggtgaaaacagtgactgtcacagagattccagtcaggccattccaattacggaactcacaaaaagccaggtgcaggacaaaccctacaaatgtactgactgtgggaagtcgtttaaccataacgcacacctcaccgtgcacaagaggattcatacgggagaaagaccttatatgtgcaaggagtgtgggaaagccttcagccagaactcctccctcgtccagcatgagcgcatccacactggagacaagccctacaagtgtgccgaatgtgggaagtctttctgccatagtacacaccttaccgtccatcggaggattcacactggggagaagccctatgagtgtcaggactgtgggagggccttcaaccagaactcctccctggggcggcacaagaggacacacactggggagaagccatacacctgcagtgtgtgtgggaaatccttctctcggaccacttgccttttcctgcacctgagaactcacaccgaggagaggccctacgagtgtaaccactgcgggaagggcttcaggcacagctcatccctggcccagcaccagcggaagcacgcgggggagaagccctttgagtgccgccagaggctgatctttgagcagacgccagctctcacaaagcatgaatggacagaagccctgggctgtgacccacctttgagtcaagatgagaggactcaccgaagcgacagacccttcaaatgtaatcagtgtgggaagtgtttcattcagagctctcacctcatccggcaccagataactcacaccagagaggagcagccccatgggcgaagccggcggcgtgaacaatcctcgagcaggaactcacacctggttcagcatcaacacccgaactccagaaagagctctgcaggcggagcaaaggcagggcagccggaaagcagagccctggctttgtttgacatccaaaaaatcatgcaagagaaaaaccctgtgcacgttattggggtggaagagccttctgtgggtgcttccatgttatttgacatcagagaatccacataggagagaaactttgctgatgacttttaaccacaagtaaaaaatgtggtaagtccacatagtgtactcatggaaggaggggctgggggtagaaatgtcatgggtgacttctgactttctaaggaaatgatgcttcccaagcacccgaggttggttggtcccaaatctatcaaactcagtgccctctttagcgacatattttgtgacattccttccattacaccacagtgagttcacaggtaatataacctacccacctgtgtaatgtcaaaaaaaatcaatatgcggccccattttgtaaaggatcattaaaatgaaagtaatttatggtagagtaaattgta

SEQ ID NO: 80809 - DNA, 1430 bp, Homo sapiens
cggccgccattgtccggcgttcggcgagtcgggtggtccctttggctggagtgcctctctggtctggggatcacctcaggcgctgtccttcactgggcgatccagcatggaccccgaggacgaaggggtagcgggagtgatgtctgtggggccgccggcggcccggcttcaggtaacaataacaacaataacgacggcggcgggctccgggcaagcgtctcccgcgcagactgaccctttcacctcgcggcgcgatgagagcggcaccgctgttaatgcccttgacacgtggggaaactcagacgcgggtcggggcgtggtgaccgtcctggccggtcagagagggggccgggattccaaccaggcgcctggcccccgaatgcgcatgctccacgcggctctgtcctccccagggctggggtcggtcattcccgagagaatcgagcaggcccatctcctgcgttcggctccgccccgccgacacccttgcccattccaggaaggtctgtcctcgtgttgactgataacagtaattgtagcgttggccgggtgcccagatggcaagaatcatcgaatagagatgctttaacgcgtggagtcagcggacacccaccgggaccccagcaccgcggagcccctgccctggggcttgggcacaacctcttgggggcaatgatgggtcaccacgcactgagtgtgatgagagtgaccaccaggtcgtcccctgcgagactgtgggagaactgcagtgcagggcggtcagtgtttgcagggccatctggccatcagagctccactttctagacaaagtggttgcggcctgtgttctccataaagctgcctcgcgtggcaggaaacaacaataattatccttcctcaagctctgcaactttgaaattatacttttttttatttgttgtcgttggtttgttcatggggatttgcattatttcagatttggtacacaaagtgagacttgataatcttaggttgcaggttttcagatgtgtgttgctccaaatttgcatgaaatgctaccacgttttattttgttcttgctgtggatgggggacaaggaatgagtcgtaagaaaggcttgagagaaagtgtattagttacctgttgctgtgtaactcaaaacttcgtgacctggaacaacaataaatatctcacgagttctgacaggagtaatggaatgtcctagctggtggttctggttcaggcccatgaagttacagtgaagatgtcagcatagctgttgtcacctgagacctgagtctggaggatccacctccaggatggctcactcacatgtctgttgataggagacctcagttgttctccatgtaggcctctctttggaactgctagggatccttgcaacatggcatctggcttcccacagaacaagtgatccaggagagggcaag

SEQ ID NO: 80810 - DNA, 2105 bp, Homo sapiens
tcgtgacacaggcctgcctgttttctccttttccattcttcctctgccagaaagcactgatggagatagtccagctgattgagaatgtgtgtgatgtttcaggaaccagtgaccttccgggatgtggctgtggactttacccaggaggaatgggggcagctggaccctacccagaggatcctctaccgtgacgtgatgctggagacctttggtcacctgctctccataggtcctgagcttccgaagcctgaagtcatctcccagctggagcaagggaccgagctatgggtggctgagagaggaaccacccagggctgccatccagcctgggagcctcgatctgaaagccaagcatcacgcaaggaagagggcctgcctgaagaggagccatcccatgtcacgggaagggaaggattcccgacagatgctccttatcccaccacgttagggaaagacagggagtgtcagagccagagtctggcactcaaggagcagaataacttgaagcagttggaatttggcctcaaggaagcaccagttcaagatcaaggctacaaaactctcagactcagggaaaactgcgtcctgagttcaagcccaaatccattcccagagatctctagaggggagtatttgtatacttacgactcacagattacagactcagaacataactccagcttagtcagtcagcagacaggctccccaggaaaacagcccggtgaaaacagtgactgtcacagagattccagtcaggccattccaattacggaactcacaaaaagccaggtgcaggacaaaccctacaaatgtactgactgtgggaagtcgtttaaccataacgcacacctcaccgtgcacaagaggattcatacgggagaaagaccttatatgtgcaaggagtgtgggaaagccttcagccagaactcctccctcgtccagcatgagcgcatccacactggagacaagccctacaagtgtgccgaatgtgggaagtctttctgccatagtacacaccttaccgtccatcggaggattcacactggggagaagccctatgagtgtcaggactgtgggagggccttcaaccagaactcctccctggggcggcacaagaggacacacactggggagaagccatacacctgcagtgtgtgtgggaaatccttctctcggaccacttgccttttcctgcacctgagaactcacaccgaggagaggccctacgagtgtaaccactgcgggaagggcttcaggcacagctcatccctggcccagcaccagcggaagcacgcgggggagaagccctttgagtgccgccagaggctgatctttgagcagacgccagctctcacaaagcatgaatggacagaagccctgggctgtgacccacctttgagtcaagatgagaggactcaccgaagcgacagacccttcaaatgtaatcagtgtgggaagtgtttcattcagagctctcacctcatccggcaccagataactcacaccagagaggagcagccccatgggcgaagccggcggcgtgaacaatcctcgagcaggaactcacacctggttcagcatcaacacccgaactccagaaagagctctgcaggcggagcaaaggcagggcagccggaaagcagagccctggctttgtttgacatccaaaaaatcatgcaagagaaaaaccctgtgcacgttattggggtggaagagccttctgtgggtgcttccatgttatttgacatcagagaatccacataggagagaaactttgctgatgacttttaaccacaagtaaaaaatgtggtaagtccacatagtgtactcatggaaggaggggctgggggtagaaatgtcatgggtgacttctgactttctaaggaaatgatgcttcccaagcacccgaggttggttggtcccaaatctatcaaactcagtgccctctttagcgacatattttgtgacattccttccattacaccacagtgagttcacaggtaatataacctacccacctgtgtaatgtcaaaaaaaatcaatatgcggccccattttgtaaaggatcattaaaatgaaagtaatttatggtagagtaaattgta

SEQ ID NO: 80811 - DNA, 839 bp, Homo sapiens
ctgtgctgcaaccttggggcattgggctctgtctttcggcccctcggggtcagacccctgctgtgttgggggatccgaagtgctcccaagctgcctggaaagcattcaggcggggtcgctagcaagaactcaggctgggcagcggaggcggcacagtgcacacactcctgcaggaacaaccagacaggggctttgggaggggctgcgtgcagggggtcccgcagaacatatgcgccccagtcccgcaggaaggaccgccctgctctctcttggctcactggtaagttgaggtcagatggggagccttgggggataggcgcctatagccaccttcctctgcagctgccatgcacacaaaaccccctgggctccctgcaacctggagctctgtctctgcctactccctgggcagatccccctgccaattcaactgtctgtgggggtcataggatctcttatagctgggatcccagaaatacgtgaggagagtgggctgccccactgtcactttactcaacccttccctaggaaacgttctgggcctggaactagtcctggcactcaccccgcgcagggttcccagcttccttcctcttcagcctcgtgtctgtgtggccgctctgtggactcagcgtttcactgcgaagatctgctcagagtgtgttggtttacgggatattttggtgtctcggtgggagcagcacttattgactgcatctgttatttttctgggaaaaatcatctaatcaagatgtttctgggagcaatgtaacacaacaattcaaacgcaagaaggcatctcatcttgagcaaataaataggaataatgccaaatgctt

SEQ ID NO: 80812 - DNA, 481 bp, Homo sapiens
gaaacagcagtttgcaatatggttttaggtctcagcattggaagttggagtatgtttaagcaagcaatcaaaagaaaattttgttgtgagattcttgtagtgctccaattttaaacaaaatcatagtttgaagaaatgtaatcttaaggtttctcccattttgttgcagctcacaatcattagttaaaactttgattcatgacagggcgtggtggctcacgcctgtaatcccaggactttgggaggctgaggtgggcagatcacctaaggtcaggagttcgaaaccagcctgaccaatatgatgaaaccccgtctctactaaaactacagaaaaaattagccgggcatggtggcatgtaaccccagctgctccggaggctgagacaggagaactgcttaaacccgggaggtggaggttgcggtgagccgagatcacgccattgcactccatcctgggcaacaagagtgaaatgccgtctca

SEQ ID NO: 80813 - DNA, 406 bp, Homo sapiens
tggaatggttctgtatctgttctacataatatgatagccactaaccacatatgtagctattgagcacttgaaatgtgttaggtccaactaagattattaatttaaatattcgcatgtggctagtgcctattgtattggacatcaaaggtctggcatatggtcctctgtaatctgaggaaggccttctgctgctggtggtgttcttgtatgctttggcagggaacaagtaggtatagagaaaagcaacatagaaatactagcccttttattcattctagtcacagtttaaaaacattataactggcaggtgcagtggctcacgcctgtaatcccaatactctgggaggcaaaggtagaaggaatgattgagcccagagaccagcctgggcaatatactgagacctca

SEQ ID NO: 80814 - DNA, 325 bp, Homo sapiens
gggagggcggggcgggctttggacctgctccctcagcctttaggagaattcctctggtgaatttcaccctctcatccgccccttcccccagggacctgctcgcctctattcttgctgcatggactcagacctcctatcccagaattcctgggatgatctggccctagcacacgaaattccccgactatctccctccattcccaggacatgagacctgcacccagaattctgagactgaccctggcacgccacatctcccaatccccacacactcctgcgacttaacctctgcacacagaggctccctgaaccaccctccctcccc

SEQ ID NO: 80815 - DNA, 430 bp, Homo sapiens
ttgaagtgacttttctagtaagttgtagaggaggaccagaatctactgctcctggaagcactaatgatttcctgtaatagatttctaatattttcacagggatttcatgagcacaggcaaaacatacagagaaaatattgttgaaagtattttgaatcactgccttctttaaagctaaggtgagatatggagggtttttttttttctccttatttcacataagtaccatgtgctaactgattgcgccactggagctcctttcttcttatttctatagatcttgtataccaaggttagattagatcagattcagtaggttgaacctcacttttgatccaagtttcttcacagcccacatctagcagagcttttcccctcaaaggcctggttagaagaagtggcctttgtttctgatgtataatttacctct

SEQ ID NO: 80816 - DNA, 368 bp, Homo sapiens
ctggtaacttcctgattgggtttccccgcctcagccctttcccagggctattctcctcccacctgctgccaggcctttccctggccatcctgtgttaaatgtcatcccgcccctactgttatgttctccacagcacttgaacacgacccaacatgccttttcacttcaaggtttattcttctattagttttcccagagtctgcttccctagtgtccatctcccctgctcgaatgcctcttgagagccagtgcttgtattttggtccttgtggtatgggcctggcacatagtaggcagtcagcagatatttatggaacaaacaaatgaatttgtgtgactatagttcattgttcatagttcattcatag

SEQ ID NO: 80817 - DNA, 583 bp, Homo sapiens
gaccttccctgtctgcagcccagctttggactgtggagatgccctcagcctctactcagtggctccagcctcatatttgcgtgctatacctttaacctcaagttctcttgctgctaacttaagctgtgactgtccaggaccggcacacacacatacatgcacgcatgcacacacacacacacacacacacacacacagaaggtgaacacacaggatgaggccctgaaaactcatttcacccgtgtacctcacccaaaaattcccctttgtactcctatctttatctctaacagacagcatgaaggtagcccgaagtcccctcaccctgtctgtcctcctgattctctagcccagttccctctagctccagcacagactcttatctccagccctgactgctgaaaccctccagccccagctccagcccctcaggaggggactgcgtgggaggaatgactccagcaagccggcagctgacccgtctctggcctgcatgcctccccctgtggtccactgccggtggtcttcagctctctcctcgtcccacccccatggtctgctgacagcccagcccagtgcatcc

SEQ ID NO: 80818 - DNA, 237 bp, Homo sapiens
tatgaaactatggatttgggtgaagaaatagaaatccattgacatggtagggtgagaaaggaaaatcattctgtaaaaaacataggcttaaattcagtcctaaggtaaatgcccaaaaactattttatatgttacctagttttaagatccatattataagcttctcaagttcttgttttgttcaatccagatttctcatctagtcaccagctaaacaaagatactgagtgcacagtt

SEQ ID NO: 80819 - DNA, 1016 bp, Homo sapiens
gattaatccggcaaaaaccatgcagaaatgaaggagctttaaaatgatcatcattcatcaacccaaccatctcccttggatacccacttcattactaagagagtaattatttttgtgttgtcagttttagggaaaagcccttgaggattattcattggtaattggaaaaataaatgttaatgtcttctgtggattaggaaagaatgttttatgactaactgtttagacgcttctgttgcattgcctgagtttggaagcttcattggttttccagccaaggcttcataaaagctttcaaattacctgtagctgtcagagaggagtctcctcaaggagatggatgaagcttgcccacgatgccgcattccaggtttttgtaataatgctgtggcagccccatctttctcccgacttttattttattttattttattttcttgagatggagtctcattctgtcacccaggctggagtgcaaatgtgcaatcatggctcactgcaacctctgcctcccaggttcaggcaatcctcccacctcagcctcctgagtagctgggactacaggcgtgcaccactatgctggctaatttttctattttttgtagagacagggtttcaccatgttgcccagactggtctcactcttggactcaggcaatcctgcctgccttggcctcccaaagtgctggccccgactcttcttaaattgtggtcccaaggccaagctgtagtgccagtgattttcctcattgaggaaatgagctcaggttattagaagtgatgaagtcagcaggcccccacaggatgaggttttagtagccacagggcttgaggtgcagcctctgggaacccaatctcttgatctacaagggtggctctggggaatgtgaaaaaattggacaaaaatactatctagccccagcaggaaggattagggtggcccttgacagtgtggagtggtaaatacacccataaaaatatgttgaagaatgaggggccggggtggaattggcttc

SEQ ID NO: 80820 - DNA, 2647 bp, Homo sapiens
gtctgtcagcactgtccgtgccattcccagaggagcctgagaagaggcagaggaagggcgaaacatggctgctctaggagtccagagtatcaactggcagaaggccttcaaccgacaagcgcatcacacagacaagttctccagccaggagctcatcttgcggagaggccaaaacttccaggtcttaatgatcatgaacaaaggccttggctctaacgaaagactggagttcattgtctccacagggccttacccctcagagtcggccatgacgaaggctgtgtttccactctccaatggcagtagtggtggctggagtgcggtgcttcaggccagcaatggcaatactctgactatcagcatctccagtcctgccagcgcacccataggacggtacacaatggccctccagatcttctcccagggcggcatctcctctgtgaaacttgggacgttcatactgctttttaacccctggctgaatgtggatagcgtctttatgggtaaccatgctgagagagaagagtatgttcaggaagatgccggcatcatctttgtgggaagcacaaaccgaattggcatgattggctggaactttggacagtttgaagaagacattctcagcatctgcctctcaatcttggataggagtctgaatttccgccgtgacgctgctactgatgtggccagcagaaatgaccccaaatacgttggccgggtgctgagtgccatgatcaatagcaatgatgacaatggtgtgcttgctgggaattggagcggcacttacaccggtggccgggacccaaggagctgggacggcagcgtggagatcctcaaaaattggaaaaaatctggcttcagcccagtccgatatggccagtgctgggtctttgctgggaccctcaacacagcgctgcggtctttggggattccttcccgggtgatcaccaacttcaactcagctcatgacacagaccgaaatctcagtgtggatgtgtactacgaccccatgggaaaccccctggacaagggtagtgatagcgtatggaatttccatgtctggaatgaaggctggtttgtgaggtctgacctgggccccccgtacggtggatggcaggtgttggatgctaccccgcaggaaagaagccaaggggtgttccagtgcggccccgcttcggtcattggtgttcgagagggtgatgtgcagctgaacttcgacatgccctttatcttcgcggaggttaatgccgaccgcatcacctggctgtacgacaacaccactggcaaacagtggaagaattccgtgaacagtcacaccattggcaggtacatcagcaccaaggcggtgggcagcaatgctcgcatggacgtcacggacaagtacaagtacccagaaggctctgaccaggaaagacaagtgttccaaaaggctttggggaaacttaaacccaacacgccatttgccgcgacgtcttcaatgggtttggaaacagaggaacaggagcccagcatcatcgggaagctgaaggtcgctggcatgctggcagtaggcaaagaagtcaacctggtcctactgctcaaaaacctgagcagggatacgaagacagtgacagtgaacatgacagcctggaccatcatctacaacggcacgcttgtacatgaagtgtggaaggactctgccacaatgtccctggaccctgaggaagaggcagaacatcccataaagatctcgtacgctcagtatgagaagtacctgaagtcagacaacatgatccggatcacagcggtgtgcaaggtcccagatgagtctgaggtggtggtggagcgggacatcatcctggacaaccccaccttgaccctggaggtgctgaacgaggctcgtgtgcggaagcctgtgaacgtgcagatgctcttctccaatccactggatgagccggtgagggactgcgtgctgatggtggagggaagcggcctgctgttgggtaacctgaagatcgacgtgccgaccctagggcccaaggagcggtcccgggtccgttttgatatcctgccctcccggagtggcaccaagcaactgctcgccgacttctcctgcaacaagttccctgcaatcaaggccatgttgtccatcgatgtagccgaatgaagggcgctggtggcctcccgtacaaacttggacaacacggagcagggagagctcaccatggaatgaaccccccgcccatgctgtccggcctgggaaaccctctccatctcccaaggctgccagacatggacctccgggctccagcacatccccctctcctctcccccaggttggggctgggtccaccctgtcctatgacttgatcacttttgcacattccctggccgcttctccccagagctgcctgctctgtgagccccacagccctgctcattcctcacgcccttcaatgctgcaggatggactggcccctgacccagggactctccaaacgggatacaggagagaagctggtctagactgtttgctgatccccaacctgcacggggcattcctgcttctctctcaggccaccacagagggcaggggatggttagtcacctgccccagcactcacaccctaactcaaaataaatgttaaataagtgcgatcacacagca

SEQ ID NO: 80821 - DNA, 2578 bp, Homo sapiens
gtctgtcagcactgtccgtgccattcccagaggagcctgagaagaggcagaggaagggcgaaacatggctgctctaggagtccagagtatcaactggcagaaggccttcaaccgacaagcgcatcacacagacaagttctccagccaggagctcatcttgcggagaggccaaaacttccaggtcttaatgatcatgaacaaaggccttggctctaacgaaagactggagttcattgtctccacagggccttacccctcagagtcggccatgacgaaggctgtgtttccactctccaatggcagtagtggtggctggagtgcggtgcttcaggccagcaatggcaatactctgactatcagcatctccagtcctgccagcgcacccataggacggtacacaatggccctccagatcttctcccagggcggcatctcctctgtgaaacttgggacgttcatactgctttttaacccctggctgaatgtggatagcgtctttatgggtaaccatgctgagagagaagagtatgttcaggaagatgccggcatcatctttgtgggaagcacaaaccgaattggcatgattggctggaactttggacagtttgaagaagacattctcagcatctgcctctcaatcttggataggagtctgaatttccgccgtgacgctgctactgatgtggccagcagaaatgaccccaaatacgttggccgggtgctgagtgccatgatcaatagcaatgatgacaatggtgtgcttgctgggaattggagcggcacttacaccggtggccgggacccaaggagctgggacggcagcgtggagatcctcaaaaattggaaaaaatctggcttcagcccagtccgatatggccagtgctgggtctttgctgggaccctcaacacagcgctgcggtctttggggattccttcccgggtgatcaccaacttcaactcagctcatgacacagaccgaaatctcagtgtggatgtgtactacgaccccatgggaaaccccctggacaagggtagtgatagcgtatggaatttccatgtctggaatgaaggctggtttgtgaggtctgacctgggccccccgtacggtggatggcaggtgttggatgctaccccgcaggaaagaagccaaggggtgttccagtgcggccccgcttcggtcattggtgttcgagagggtgatgtgcagctgaacttcgacatgccctttatcttcgcggaggttaatgccgaccgcatcacctggctgtacgacaacaccactggcaaacagtggaagaattccgtgaacagtcacaccattggcaggtacatcagcaccaaggcggtgggcagcaatgctcgcatggacgtcacggacaagtacaagtacccagaaggctctgaccaggaaagacaagtgttccaaaaggctttggggaaacttaaacccaacacgccatttgccgcgacgtcttcaatgggtttggaaacagaggaacaggagcccagcatcatcgggaagctgaaggtcgctggcatgctggcagtaggcaaagaagtcaacctggtcctactgctcaaaaacctgagcagggatacgaagacagtgacagtgaacatgacagcctggaccatcatctacaacggcacgcttgtacatgaagtgtggaaggactctgccacaatgtccctggaccctgaggaagaggcagaacatcccataaagatctcgtacgctcagtatgagaagtacctgaagtcagacaacatgatccggatcacagcggtgtgcaaggtcccagatgagtctgaggtggtggtggagcgggacatcatcctggacaaccccaccttgaccctggaggtgctgaacgaggctcgtgtgcggaagcctgtgaacgtgcagatgctcttctccaatccactggatgagccggtgagggactgcgtgctgatggtggagggaagcggcctgctgttgggtaacctgaagatcgacgtgccgaccctagggcccaaggagcggtcccgggtccgttttgatatcctgccctcccggagtggcaccaagcaactgctcgccgacttctcctgcaacaagttccctgcaatcaaggccatgttgtccatcgatgtagccgaatgaagggcgctggtggcctcccgtacaaacttggacaacacggagcagggagagctcaccatggaatgaaccccccgcccatgctgtccggcctgggaaaccctctccatctcccaaggctgccagacatggacctccgggctccagcacatccccctctcctctcccccagagctgcctgctctgtgagccccacagccctgctcattcctcacgcccttcaatgctgcaggatggactggcccctgacccagggactctccaaacgggatacaggagagaagctggtctagactgtttgctgatccccaacctgcacggggcattcctgcttctctctcaggccaccacagagggcaggggatggttagtcacctgccccagcactcacaccctaactcaaaataaatgttaaataagtgcgatcacacagca

SEQ ID NO: 80822 - DNA, 254 bp, Homo sapiens
attacttcgtttttctgcttatattgctatttccttgtagcgctatgttaaattgctaattactactttttgtattctacttttcctgaagaatctgtatatggacttttagggccagcagaaataacttgttttagtactattaacactctggggaggaaactggtacttcagtgtattgcgaaatgcaaagcgtttgaaaaagtagtgatggatgatgagaacgacagcgagagtcgctgcgtgtactgctg

SEQ ID NO: 80823 - DNA, 386 bp, Homo sapiens
atactaccagattagtaatcctgctctcctaagcatactgagtggtagcctatgatttcttttgtggttcaaaatatgccctgtagcctgtgttttggttagcagaatggccagagcttagactaaaggccacgactcacacattccaaatacatataggcttgaagttatcctattataaaacagttaccacattcatgtaaatggccaggcaaaggtcaaaatatgagcaacattatttgtagctcagtgagagatttgatgttcaaagtctgtcagcatttgtcagaagactgatattgtcaatggctgtttcagattaagaccaactaaaaagtgatttggtgtgaactcagaatatagggaaaataagacaatttgaatgt

SEQ ID NO: 80824 - DNA, 762 bp, Homo sapiens
acagattcatagtttataaatttactttttttgaatgactaatttagttgactcttggttatctaggaacagattaaatggtaagtagttagccatggtattaaataacagtgtacttgatatgaagaattgaaattaatgtaagaaaatattaatatatttatactataatgtaattctgtttagaattatttggtacctactctagcttgggaatgttccttgatctcagctgtcaaagtaatttttggaagcagtgcctgcattctcttccagtctctagggaacagtggtctgcatatggggctgtgctgtgattggtggatatttctaacatattggctgcaaatactaatgtagttacagttcttttaaacgtttgtatgcgttctttcaaatggtaaatgtattctgaaatataggatgtgaattttagctaaattagtttaaaatgtcattttatgtggcattttaattagttttatgttaactaggattttggatatgtgagaacttttccttctacttttttttggctgcttaagaattatttctttacataaacatgtatgcacatgcatatatgtaggcaaacaatgtgtgtagtatgatcccaggtttagcatttcagctatataagtgatgtgataagttatgaaaatttaaatgctctgagtaaatcataattatggacaattatgaagtgtggagaaaatcctttaaaataattttggagaattcattttttttctatcagataca

SEQ ID NO: 80825 - DNA, 231 bp, Homo sapiens
cgccctcgcaaatgactcccgctcggttcggcctgggggaggaggcgccctcatggctactgcaggcctctccaccctccggactgggctgggcagcggccccgtcgcacgcaaccccccgcgcccttgccgggccgaacgggcgccgcgcttctcctacccgccgctagtgaacccagcccagagagaaacaaaggctcgggctccaggacccgctcggccaggccagcc

SEQ ID NO: 80826 - DNA, 466 bp, Homo sapiens
acaggaattaattttcttacagttttggagactagaagtcatagattaaggtattgcctggcttggtttctcctaagacctctcttcttgacttgcaggtagccaccttcttcccactttgtcctcacatggccttttctctgtgcctttgcatcccctcttgtctatcctttttgtaaggacactagtcatattggattagggcccacccatatgactttaaccttaattgtctctttaaaggccctatctcgaaatgtagtcatatcttgaaggaacatgtttcagtctataacagaaggttttttaatttccaggtaggagaacctttttaaaaagttaatttcggctgggcgcggtggctcacgcctgtaatcccagcactttgggaggccgaggcgggtggatcatgaggtcaggagatcgagaccatcctggctaacaaggtgaaaccccgtctctacta

SEQ ID NO: 80827 - DNA, 944 bp, Homo sapiens
attggcacccctagcattttaaattgatacaaagcattgaaattttgatatctttaagatgttactgttatcacatgacttttgagaatcccaaaaccctaaaaataagtctcgataagaaataataaaacagaaatattttagaaatagttcttaagcctttctgattacatgcaccattacaaatatgatagaaacagtgacccctcctcccagaaaaacgcacatgaacacagaatgtcacatccagttttagggatttcatgaacttcaagaagttcaccttggggtccaggctgatactcctgctttaagattttgtttttctttgatagtctgttttgtccttgcctccaaaattttggtgcaagttgtaatataatgagttcgttcgtttttgttatttcaacttcagctgtgcataggtggccctgtgtcccagtctgcccaggacagcccactccatggctattgattggttttgtttattcataattcccactcttgaaggtatccccaggtacagtggctcacacctgtaatcccggcattttgagaggctgaggcaggcagatcacttaagtccgggagttggagaccagcctgggcaacatggcaaaaccccatctctgtgaataatacaaaaatattagccgggcccggtgcctgtagtcccagctactctgatggctgaggtggcaggattgaatgagcccaggaggtagaggctacaatgagccatgatggtgccaccgcattccagcctgggaaacagagcaagatcctagctcaaaaaaaaaaaaaaaaaatccctatttgaaccaggtgcaactgcagtggtgtgcaccatatctcagctactaagaaggctgaggccagaggatctcttgagctcaggagtttgaggccagtctgggtaacatagcaagactctatttcgatta

SEQ ID NO: 80828 - DNA, 561 bp, Homo sapiens
cagagtacagcaaggcctcctgtctacctcgcaggacggggactcagaacactaacaaaccccaactcaaactagttttcacaaaagaaaatgtacgaccttgcaaaacaagaagagcagaggtcaggtgagagccagcactggctaattcagcagctcagcaagagctccaaggacctgggtgttttccaacctctccaggccaccctcctcacgggccagcttccacctccacctgaatgctgagcctttgcctaatttcctccctgatttcagttcaggtaacacttcccaggggcagactttcctgcctccctcctgtggtcagtccattttcccagctcttggatcacacctgggtttgctgcagtttcccttattacatgatgctgcagttaatgtcagccctccctattagactctaagctccataagggcaggaactgtgcattcttgctcactgttgtgaccctagagtctgccactcaaatatttgtcaagtgagtgaatgacagctctgtgcagggccaaggaacccgagccacaataaacatgccatat

SEQ ID NO: 80829 - DNA, 283 bp, Homo sapiens
gctgacttggagttacagtccttctcccccggtgcaaagcccaggaccaagggccagaaattagctttttatctttttataccaagtataagatttacatagtacttatcatggagagaaggatgagagagaagctgtgaaaacttaaaggaaacaataaaatagaaatgcagatggctccaagagggaaaggaggaagaatgagagagaaggcagagagaatcgggaaacagagaacacatttatccatccgcgaacctcaccgagcgcccatacagcaggc

SEQ ID NO: 80830 - DNA, 589 bp, Homo sapiens
cttcctctcatagctaactacaccatcactcagacagccaactcagagctcaagggtacccaccattccctcctcctccatcttaccaaaactcactcctcattttgtgagtgtcttgacaatccttcccttacccacatttagaacccatgccctcctctggaatccatgccctcctctctgtcctgaccaacctcctgtatttcttacctctgcaatttcagccatttttgttgttgttgttgagtttccttgctgctaatcccaacccttaagcatcacttctatggagccttctatgaattttttcccacttttctctcgtccctatctggccccactgtacgttgattcttattcctgttacagcctttatcatcctgaactacaattacctgtgtatctgcctccttctaaacaaggctgttaaaactcagtctccagatagtactggacatagtgcagaaaaacaatcaacacctgagaagtggattgatggagaaaaagaatgcaaatccacatgtgcctctctaccttacctctgtacctctttacaatattagcacttccattaaaatgccatccaagt

SEQ ID NO: 80831 - DNA, 757 bp, Homo sapiens
aaagaaaaactgatgaaactaaaatgaaaaaatagataaatctataattatatgtgaggattttaacatcttattcacagtaattgatagaactccttagacagaacatcatcaaggaaagagaagatctaaacaacacagtaaacctacaggaataaattaacattcatagagcattccacacacaaaaaaaactagcagaatatacatttgtgtacgtgtgagcctgtggaatattcaccaaaatcaatcatattttaggctataacaaaaatctcaaaaattgcaaaataattaaaattatatgctgtgctcactgatctgttctttcttttgttattttagattcaaagatatttgtgcaggtctgttatgtggacatattgtgtaatagtgaggttttagcttttagtgaacctatcacccaaatagggaacattgtacccaataggaaatttttgaacgcttgtgccgcttctacccaccccttctgggatccccagtgcctattatttgtatctttatgtccatgtgtacccattgcttatctctaacttataagtgagaacatgtgatatttgattttctgtttctgaattattccacttaggataatgacctccagctcatccatgttgatacaaaggatataatttaattctttttatggcttcatagtattccatggtgtatatatgccatattttctttatccaaataatcactgatagatacttaggttgattctatgactgtg

SEQ ID NO: 80832 - DNA, 491 bp, Homo sapiens
ttttaaagtgttaaagcaatttaggagaatggatttttaaagtgtgttttcatagacatgacttgattcagttttcatgctgtgctctttataatcctcccatttttgctaattatgaaagatatttgtgctgagggattatctgtagggagcatctaactaggaggaagagaagctggatcctcatccagttctgtgtgtctaatagctctgtgacctgaggcaagtaactcataggccttttccatatttaaaattcttactctaagtgagacaccagaataccgatctgtgatggcacaatcgtttctatgcaagcatattgtgattgtaacacttgatgtttttattgggcatcagcaggcagagaacccagaatgctgtttctattgaagcccagtgaagtgatggcaaaccaaagtgaaaagtcaggggtgtgtggccatggtggccttctccctcccctccggatgtcctctcctggtgccttg

SEQ ID NO: 80833 - DNA, 267 bp, Homo sapiens
tgccaaagcgtagtacccaaggccaagaatagctaagacactcctgaagaacagctaggcaaggagattcttcctaccagatgtcaaacttaatataaagtggtaattaatatagtgtcctttgggcaaaggaagatgcagagggatcagtagggccaaattgcatgcattgaaacagacatgctgtagtcggcattgcagctcagcggggtgggggatggacttggcaatgatggctgctgggatgcttgggtactacgtttggca

SEQ ID NO: 80834 - DNA, 352 bp, Homo sapiens
ataatctgctttggatctgctcttgtatttataattttgtatactattccttagggaagttcccccacattgtataaacttcatcctctacaaaactagcatgggccccttgtaggcttcttgcaaatatgccgcatcctccctccagcagcactgagcgcccagagtttgtgcagagtgggtgcgtcttgccagtgttgacacagagaatgagccggaatgagccgagaccagagaaaccccggcccacccagccagctgtggactactttggtgcttccttctctcttcaaagcattctcagatctattatttcacgtggccactggttgggcagatcaccaaatcccca

SEQ ID NO: 80835 - DNA, 1250 bp, Homo sapiens
tttaacttagataaaaaaaaaaaaaaaagaaatcgttttaataggagatttttaaaaaagtttctccggaatcgactcggttcatcaggaagctgcgaacgtgataaatgcgtttgaccgcgcaccttgtgtcgctggagctgagaacactttgttccttttgtttcactcaacttgccgacatctaactcagggacacgggtatgcagcttgtttgacaaataagccgagatacaccgaacatattcacacataccaatagacgatgattggaagttcaggatgcagtcaaaataaatgcttgcgtttggcccaggtttcacataacaccagtttcataaggcacttaggccgctaacggagcagtgcccctgaaaatagcccacaggggacacatcatttaaataaatgtgtttctttccctgaacagaagttcagttctgctcaattatcattaattttgctcctttatttcctttgcgggcgtgaacggagaagtcgtgctctttgaggttttgcgagctggccttggctggcagaggtgaccggcaatccttcagccggcggaaaaagtgcgagtgtgtgtgtgtgtgtgcttgtgaaaatgtgccgttcctcccagaaaaagtggaaacgtaggtggaaagctcagcacatgttggcgacacctaaaaaccatgttctcggtcctgaacctttagaagcggtatcccaggaacgagtctgagtctgtgcaacagggcacagatgattcgacaaacttcaatgactgcaccgcattcatgcattatatccattgaaaagtaaatccagcgtctccactcgcgcgcccacgtgcgtggataaacgcgggaattcggcagccctcaacgtcactctgcagagatttccgggctgtgagagagttggggtgtgcggcgggggaggggagggtctgatatcttcaggttgagagtcaagtcctgggggagcggcatgggcgggggtggccggggagaggcggaggatggagcgcgaaccagaaagcgcagaggaccctcggcccgcgccgcacccgctgtgattagctccagaggcgcgatccgggagggcggactctttcttaaccctcattgtctcctcctccctcttcctttttaaaagacgccttgcgggcagagctgtcagcaaccccgcggccgtttgtacttggccgcggcggagctgactcctgctcctgtgacagataggggctggggctgagcggccgc

SEQ ID NO: 80836 - DNA, 108 bp, Homo sapiens
attaataaatggaaaaagattaatgcctgaactgtaaagtttattattataaagatgccaattgccctcaaaaaaaaaccttaaacttcaatgcaatcatttaaaaac

SEQ ID NO: 80837 - DNA, 990 bp, Homo sapiens
gacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctgtggcatattgcttctgcctcagtgtatcactggagtcacaggaccctgcccacctgagttcccaataaagaaaaacctccccttctgaggctgctttcccaaaactccccctgcatctttatctcttcatctatcccacctcttgtctgaacatcccacctttatcctgtgttctgcctttgttttaattttaactcatgttcatcctgcaacagaagcattctctaggtcccagtttccagttgattgcatatccttgatcagccctttttcccatcctgccctatggttctctagccacctgtgcatgcatgtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcatgtttcattttcctgaagatttatgtttttgtctaccttgtgagcaggcttttggaagaacctgtttgatgcaaaaaagaaaatgaaaaacaaaacaaaaaatccccaaaaccttattatgggagcccgtcggtcttagaagctgtttgacatgtataataaatggcattgactgggcctgttttacatttggtgagaacattcca

SEQ ID NO: 80838 - DNA, 314 bp, Homo sapiens
tgacatggacctgtagtcccagctactcaggagtatgaggcaggaagaacccttgagccctggagtttgcaactacagtgagctatgatcatgacaaattagggtaacaacatccaggccacacctcttaagactcccagaaatattttctaagcctatagtgcctttcatacccctcggacgttctgtcttgtctctcataaaatgatactacagacataataagataaatctggagtttgcagtcccagtactaaagatcgtatcaatgataattaataatgacgaaaagaaatcagttgtagttaagatac

SEQ ID NO: 80839 - DNA, 2045 bp, Homo sapiens
  misc_feature (687)..(687): n is a, c, g, or t
  misc_feature (712)..(712): n is a, c, g, or t
ggggacctttagaattttgatagcaatttctttgaatctgtagattactttgtgtagtattgccatcttaacaatattaaatcttccagccaggcgccagtggctcaagcctgtaatctcagcattttgggaagccaaggtaggcagatcacttgagcacaggagtttgagacccccccgagcaacatggcgaagcctgtctctacaaaaaataaaaaatcagccaggtgtggtggtgcacgcctgttgtcccagtgctccagcctggctgacagaggcagaccttgtctcaaaaaaaaccaaaactaatattaagtcttccaatccatgaacaaggatatattttcatttatttagatcttttaaaatgtgtttcagcagtgtttttgttcatttgtgtgtttgtttttagttttctatatacaaatttcttcctgggtattttattctttttgatgctcttaaagggaattttctcaattttctttttggattgttcattgggtatgatgttagctgtgggtatttcatgaataccttgctttacatatttttaatgcagtgttttttggtgtgtaagattttgactcctgtatcttctgggtggattaaaatttgtattataaatgatattaaatgtatctgactctgaggctttttcttaatgtgcattttcttcttatatcntgcccagctaatttttgtatttttngtagagacagggtttcaccatgttggccaggatgtcttgatctcttgacctcgtgatctgcctgcctcagcctcccaaagtgctgggattacaggcgtgagccaccatgcctggcagcctcccttgtatttctaacagcttttgctgtctatattttttaattaaggtgaaattcttgtaacaaaaagctaaccatttaaaaatatacaattcaacagcatttactacattcaaaatgttcacaaatacctcctctatgtggttccaaaacatttcattttgaaactacaaaataggatccattaagctgcccctccctattctccgctccactatctcctggcaaccaccaatttcctttctgtctctgaatttacccgttctggatatttcgtataaatggcatcatagaatgtgtgaccttttgtgtcaggcttttttcacttagcataatgttttacaggttcatctatattgtagcatgtgtcagtagttcattcatttgtggctgagtaatattctgttatatgtatttaccacattttgcttagccattcatctgttgatgatatacatataacagaatattactgtggattgattccaccttttggctattgtaaatagcactccttcaacatttgtgtacaagtatttgttggagtacctgtttttaattctttaggggtgtatatttaggagtggaatttctgagtcatcttgtaattctatgtgtaactttggaggaatttccaaactgttttctgcaatggctgcaccattttacattcctgtcagcaatgtacaggattccagtttctccatatccctgccaacacttggtattttcctttttttcagttagttactctagtgggtatgtggtggttgtcccattgctgtttgttttgattttcattgtccctaatgactaatgatattgagcatctaatatccagttgtcccagcaacatttgtttgaagagactattctttcctgtgtaaatggtcttggcatctttgttgaaaatcgattggcagccaggtgcagtagctcacacctgtaatcccagcactttgggaggctgcgctgggcagatcgcttaagctcaggagtttgagtccagcctgggcaacgtggcaaaaccatgtctctactaaaaatacacaaattagccaggcatgatggcacgtgcctgtagtcccagctacttgggggactgaggccggaggatcacttgagcctgggaggcagcggttgcagtgagccaagattgcaccattgcactccagcatgggcgaacacagtgagaccctgtctccaaaaaaaaaa

SEQ ID NO: 80840 - DNA, 384 bp, Homo sapiens
aaatatcacataaggcaggaaggagggctcaagaatgtcatttcttcctttaagataggaacaattttcagatacaggatgtggtgaagatgaccaggtaatgtatgttgaactccaacagagatctgtgtttttcctgaatgtattgagtggatcaaatataacaagctggataatttccctctaatgaataactgactgtttaaaattgtatggaagtcctttggcctgcaagctggcatttggatatttgatgatgggtctttactctttaatgggttctcagaacttaactttgcaacttgtcaactaaggtgctccttgcttgggtccaatccatcttaattccctggcctttttcctcatctggttttgcctgtattt

SEQ ID NO: 80841 - DNA, 463 bp, Homo sapiens
cctgatttctgtgctgttttgtgccggaatgtttcgacagtagacctttgaattgaacagaggtaaaggtgatctatagtaccagctgtgttctcacccactcctccccctcatctgaacaaaaccagtgagttccagaagattaatattaggaaatgcaagatgcaggcatatgttaaaatttctgagtaagctaacatatacagtttcttaactttttcagagcctcagtttactaaatgatccatctattattccaggatagacattttagtcataaccatatatgtcaaggagttagttatgggtttaaccctttgatgtatttagtccttttgttctcaatatatttatacttctttatagaactcactgagagagttcagttctaaaaacttagtatgaactatagaatgacagaagtgattttatggtaatattaatatgtaaaagttgcattccc

SEQ ID NO: 80842 - DNA, 2832 bp, Homo sapiens
ttagggggaaccgcaggaccttttcatccccgtggtcccacggtcgactcgtcgccccgtgaggcggtgccagtccccgctcggacgctcgttgggccctatacccgccgccatggtcttcaaccggacgaccctctgcgcgcagatcatatggtaaacggaaccagtggaagacacagaccctagcactttatcctttaatatgtcatgacggagtatcccattcaagatacggaactccctaaagctgaagaatgtgatacaattactttgaactgcccacgaaattcagatatgaaaaatcagggagaagaaaatggctttccagatagcactggagatcctcttccagagatcagcaaggacaactcctgcaaagaaaactgtacttgttcctcctgcttgctccgggcccccaccataagtgacttgctcaatgatcaggacttactagacgtgatcaggataaagctggatccgtgtcacccaacggtgaaaaactggaggaattttgcaagcaaatgggggatgtcctatgacgaattgtgcttcctggagcagaggccacagagccccaccttggagttcttgctccggaacagtcagaggacggtgggccagctgatggagctctgcaggctctaccacagggccgacgtggagaaggttctgcgcaggtgggtggacgaggagtggcccaagcgggagcgtggagacccctccaggcacttctagagctcttcttcttccttcattggcctctccggatgttgaaacaaccacaggtcaagaaggaatgtgaatctgttgttttataagagtttaggacaaggacgtggaacagtggacactggttttccccaaagctggcagttttgtggaggggtagcttgtttcggtggtggatctctgtttatttttgcacatctgttataatttaatattcaaatctggaattaagaaaacatattttctagtatcctctaagggccaaagtcctacaatcggaatggattcatgccacgttgaagataaaattatcctctctctgaaatacggtaaagatttaaataggtcctgagactgttgatagccccagacatacccacagcattatatgtaacatctctcctgatcagtgccattcccacggtttcaaagaaaacagctacaaggaatgcttacctgagtgtctgcagcaccctccacttctctcctaggcaatgagacccagtggctagaaattcaccatgtctattctcaagatccatgccagggagctctttgactctcgtgggaatcccactgttgaggttgatctcttcacctcagaaggtctcttcagagctgctgtgcccagtggtgcttcaactggtatctatgaggtcctagagctccaggacaatgataagactcgctatatggggaagggtgtctcaaagcctgttgagcccatcaataaaactattgcacctgtcctggttagcaagaaactgaacgtcacagaacaagagaagattgacaaacttatgatagagatggatggaacagaaaataaatctaaatttggtgcaaatgccattctgggagtgtccctcgctgcctgcaaagctagtgctgttgagaagggggttcccctgtaccaccacatcgccgacttgtctggcaactccaaagtcatcttgccagtcccggtgttcaatgtcatcaatggcagttctcatgctgtcaccaagctggccatgcaggagttcatggtcctcccagtcggtgcagcaaacttcagggaagccatgccattggagcggaggtttaccacagcctgaagaatgtcatcaaggagaaatatgggaaagatgccaccggtgtgggggatggaggcgcgtttgctcccaacatcctggagaataaagaaggcctggagctgctgaagactgcgattgggaaagctggctacactgataaggtgatcgtcagcatggacgtagaggcctccgagttcttcaggtctggaaagtatgacctggaattcaagtttctcgacgaccccaccaggtacatctcacctgactgtctggctgacctgtacaagtccttcatcaaaaactacccagtggtgtctactgaagatccctttgaccaggatgactggggagcttggcagaagttcacggccagtgcaggaatccaggtagtggaggatgatctcagagtgaccaacccaaagaggacagcctcggccgtgaatgagaagaagtgcaactgcctcctgctcaaagtgaaccagattcgctctgtgactgagtcccttcaggcgtgcaagctggcccaggccaatggttggtgtgtcatggtgcctcatcattctggggagactgaaaataccttcatcactgacctggtggtggggctgtgacctgggcagctcaagactggtgccccttgctgatctgagcgcttggccaagtacaaccagctcctcagaattgaagaggagctgggcagcaaggctaagtttgccggcaggaacttcagaaaccccccagccaagtaagctgtgggcaggcaagcccttcagtcacctggtggctaattagacccctccccttgtgtcaactccggcagctcaagacccccgagcaacatttgtaggggccgctgctagttagctacccttgcccaccgccgtggagttcgcacctcttccttagaacttctacagaagcaggttgcagtgagccgagattgcgccactgcacaccagtctggagacagagtgagagtccgtcccaggtcgacgcggccgcgaatttagtagtagtaggcggccgc

SEQ ID NO: 80843 - DNA, 1078 bp, Homo sapiens
gagtatctgtgggtacccggagcacggagatctcgccggctttacgttcacctcggtgtctgcagcaccctccacttctctcctaggcaatgagacccagtggctagaaattcaccatgtctattctcaagatccatgccagggagctctttgactctcgtgggaatcccactgttgaggttgatctcttcacctcagaaggtctcttcagagctgctgtgcccagtggtgcttcaactggtatctatgaggtcctagagctccaggacaatgataagactcgctatatggggaagggtgtctcaaagcctgttgagcccatcaataaaactattgcacctgtcctggttagcaagaaactgaacgtcacagaacaagtccttcatcaaaaactacccagtggtgtctactgaagatccctttgaccaggaatccaggtagtggaggatgatctcagagtgaccaacccaaagaggacagcctcggccgtgaatgagaagaagtgcaactgcctcctgctcaaagtgaaccagattcgctctgtgactgagtcccttcaggcgtgcaagctggcccaggccaatggttggtgtgtcatggtgcctcatcattctggggagactgaaaataccttcatcactgacctggtggtggggctgtgacctgggcagctcaagactggtgccccttgctgatctgagcgcttggccaagtacaaccagctcctcagaattgaagaggagctgggcagcaaggctaagtttgccggcaggaacttcagaaaccccccagccaagtaagctgtgggcaggcaagcccttcagtcacctggtggctaattagacccctccccttgtgtcaactccggcagctcaagacccccgagcaacatttgtaggggccgctgctagttagctacccttgcccaccgccgtggagttcgcacctcttccttagaacttctacagaagcaggttgcagtgagccgagattgcgccactgcacaccagtctggagacagagtgagagtccgtcccaggtcgacgcggccgcgaatttagtagtagtaggcggccgc

SEQ ID NO: 80844 - DNA, 645 bp, Homo sapiens
atgcgtctctgctgatctgagcctgtcctgcagcatggacctgcaactttcctgaagcatctccagggctggatgccatgatattgagacccagagacctgattctcagccagctggtcttagccaacaacctggttcttttctctaaacgaatcccccagacaatggcagcttttggaatgaaatccttcctggacgaggctggatgaaacttgtcttctatctatacacagagtggccagaggggtttccctcagcaccgcctgtctccccagtggcttccaggccatgaagcttcaacctcagtatctctaggaggatggaactccgaattaggtccacaaagtgcattgttttctgctgccccctctgctggatcttgcaaattgtggcatatacccatattgcaatgcatgtaactggcccaatgaagagcaaaaacgtgagtatggaataaatgtataggtactctcctcacccattctaggatgattgctattcttagcaaatgcagtcattttctcccttgtggatggtatgtctttggccctcatggactacaccagcagctccatgatcctcttcttatatagacacaagcagacagtccaatgcattcgcagccacggcctctccccctgaaaa

SEQ ID NO: 80845 - DNA, 477 bp, Homo sapiens
gaaaactatattcttgatgacacagttgagctacagaattgtccaaccccggaggtgccccacttcgcgttgtgggagataatgcattttccttgctgtttaaaccactttgagctgagttttctattaccagcagcctaaagcattttgacagataaaagtagatacaaatgcacatatataatgagcatcctgactgaacgattaaatgtgtatgtaggcatgcattacctccccactccatttatgattgtcacatttatttttacttcagggaaaagcaactatagaatttaaaaaatcaggattgaaaacaaatacctgaatttcctacaattaaaaaatcaatccattaagtagtggtattatgctaaaataaaatgaatgcttagaaatttgttaagtgtttatgatgtaataagacatcaaataaaccatttttctttaagttctttaataaaaaaaatctgatgtgga

SEQ ID NO: 80846 - DNA, 663 bp, Homo sapiens
gggccgggggcttgggctccagagtctgactgtgtgtttgagtccggctgtggaaacctagccattgagatgccccctcttggtggctctgtcctcttaggatgggacaagtctgtgaaggctgctgcagcacccaccgtagacccctaatcgtgtgacgtcaccaggatggtccgggctgctcacttgccacagtggcctgtttgagcccgggaagccaacggggctgctcagctggacaccagccccccgagctgcccatgttggggtcacaggccccacctccctggttggggaggggcaactgagagtgtggagaggtgggacccaggtgtgctggtctccgcaggggctggatcagagcctgggatgggcagggtgagcctcctgacctttaacccagtggtgtcaggcaacgtggcccacccgccagccgcaccaggccccacccccgcaggtgaaggggtgggataggctgggcctgggccaggacacctctggaccacgcattcctcattgcttgggtccctggagcagcagggcctcccgagtgtggtgccgcctgccacctagtggccatttccacgaactcccaggcctggctggggagccggaactgcagcctccatttccaccccactccgggtcgggccacctccctga

SEQ ID NO: 80847 - DNA, 308 bp, Homo sapiens
atccacccactgcccccaaaacattgctcttaactccaccgcctatcccaaaacctataagaaccaatgataatcccaccaccctttgctgactccttttttggactcagcccgcctgcacccaggtgaaatcaacagccttgttgctcacataaagcctgtttggcagtctctccacacggacacctgagacagaaacctgagagtaatcactggactacaggcaacttagaaacagggacagctgttcatctttgaatcaccagatcctaccacagtgtccgacatggagaaggtgttcaatctat

SEQ ID NO: 80848 - DNA, 797 bp, Homo sapiens
ttcccgcccgtgcctctccctccacacctccccgcaactgagggagccggctccggcctcggccagcccagaaaggggctcacacagtgcagggccgggctgaagggctccttaagggcggccagagttggcgccaaggctgaggaggtgcccagagcgagcgagggctgccagggctgctagcaggctgtcacctctcaatagcagttttgtatatgggatctagcccctccctaagaggttgattctaaggaagccaacagccgtgttgtgagtacccaatggaaagtctgttgtggcagaaaactgatgtctccagccaacagcactgaggccctgagacctgccaactgtcatgatcttccgatgcctggacacagaaagagcagtggaaggggtcgttgcatgagcaaagacaaagagtgggacactgactgttacatctcaaggagaaggattgccagatcaaaagtcttgcagttaaccaggcgtggtggcagatacctgtaatcccagctattcgggaggctgaggcaggagaatcgcttgtacccgggaggcagaggttgcagttgagctgagaccgcgccattgactcctgcctgatgacaagagaagaatctacgtctcaacaaacaacaacacgcttgggcactggtattaactccataatccggtttattcataatgctgccatcatccaaaccatcatccaacctatttatcattcaccaatgccaccctgtgaatactggctttccattgactctttcaaaattgctactgggcctcaccaa

SEQ ID NO: 80849 - DNA, 253 bp, Homo sapiens
agatccactgttgaaattggcacttttctgtacttgtctctgaccagcaaaggcaaggaacattgcgtaaaataaattactgttgaattattggggcaaagtcaggttaatagcttaatccaaaaaaggaattacaagtgaaagaattttaccttaaatgtcattctgtttcattttgtaattaagaccttccaaatgtgtaagtagtaatgaccagaaatcttatcagatatggtcaaatgagaaaggtatt

SEQ ID NO: 80850 - DNA, 3057 bp, Homo sapiens
tttttctcttaatctgccttactattttctaatgtagttactgatcaaacttagcagtaacccactcattttgtgtgtaggcaaaagcaactatgaataaacagaagaagtctcccacagtgggtaaatgtgtggacctgggtttgaaacctgatgaaacttgctggctgtgaccccttgggccagggattaactgctgtcactcttagttccctcaaccctcaggtgcatgtgattatattcactgcctgatatggtttggctctgtgtccccacccaactctcatcttgtagctcccataattcccacgtgttgtgggagggacccggtgggaggtgatggaatcatgggggtgggtctttcctgtgctgttcttgtgatagtgaatgtgtctcatgagatctgatggttttaaaaacgggagtcctcctgcacaagttctctctttgcctgctgccatccacataagatgtaacttcctcctcctttccttctgctgtgattgtgtatcctccccagccacatggaactgtaagttcaataaacttctttcttttgtaaattgcccagtctcaggtatatctttatcagcagcatgagaacagatcaatacagtaatttggtagcaggtagtggggtgctactctaaagatacctgaaaatgtggaagtgattttggaactgggtaacaggcagaggttggaacagtttggagggctcagaagacaggaaaatgtggaaagtttgaaactccctagagagttgttgaatgactttgaccaaaatggtgataatgatatggacaatgaaatccaggctgaggtggtctcagatggggatgaggaactttttgggaagtagagcaaaggttatgtcttgttatgtgttagcaaagagactggtgggattttgcccctgacctagagatttgtggaaccttgagcttgagagagatcatttagggtatctggcagaagaaatttctaagcagcaaagcattcaagaggtaacttgggtgctgttaaaggcatttagttttataagggaagcagggcatgaaagtttggaaaatttgcagcctgacaatgcaatagaaaagaaaatcccatattctgaggagaaaatcaagctggctgcagaaatttgcatatgtaacaaggagttaaatgttaatccccaagacaatggggaaaatgtctccagggcatgccagaggtcttcacagcagcccctcccatcacaggcctgcaggcctaggaggaaaaagtgatctcttgggccaggcccagggtccccatgctgtgtgcagcctggggacttggtgccttgtgtcccagctgctccagccatggctgaaaggggccaacatagagctcggattgtggcttcagagggtgcaagctgtaagccttggcagcttccatgtggtgttgagcctgccagtgcacagaagtcaaaaattggggtttgggaacctctgcctagatttcagaagatgtatggaaatgcctggatgccctggcagaagtctgctgtaggggaggggccctcatggagaatctctgctagggcagtacagaagggaaatgtgggatcggagccccagcacagaatccctactggggcaccgcctagtggagctgtgagaagagggccaccatcctccagaccccagaatgatagatccactgacagcttgctccatgcacctggaaaaaccgcagacaacaccagcccatgaaagcagctaggcaggaggctgtaccctgcaaagccacaggggcggagctgcccaagatcatgggaacccacctcttgcatcagcatgacctggatgtgagatttggagttaaaggagatcattttggagctttaagatttgactgcccctctagatttcagacttgcatggggcctgtagcccctttgttttactcaatttctcccatttggaacagctgtgtttacacaatacctgtacccccattgtatctaggaagtagctaacttgcttttgattttacaggctcataggtagaagtgacttgccttgtctcaaatgagatgttggactgtggacttttgagttaatgctgacatgagttaacactttgggggactgtttggagcacatgattggttgtgaaatgtgaagacatgagatttgggaggggcaaggtgtggagtgatatggtttggctctgtgtccccacccaaatctcatcttgtagctcccataactcccacttgttgtgggagggacccagtgggagatgattacatcatggggctgggtctttctcttgctgttctcatgatagtgaatgggtctcacaagatctgatggttttaaaaacgggagtatgcctgcacaagctctctctttgcctgctgccatccacataagatgtgacttcctcttccttgccttctgccatgattgtgtggtctccccagccatgtgaaactgtaagtacaataaacttctttcttttgtaaattgcccgctcttgggtatgtctttatcagcagcatgaaaatgaactaacacactaccttagagtgttagtgtgaaaagaggcaatgtttgaaaatttttagcttggtgctgcccacactgtgagcattcagtaattgtgagctgtaatgctcactgttgtgttccattcccacagtaatttttgtgtatgtgttttgattttttagacttaaaaaatacagttttagatttatagaacaattgaacagataatacatagagttctatacacccaccccatccctacctctcaatttccctccacaatttcccctattattaacaacttgcattggtgtggtacatttgttaaaattaatgaaccaatattgatacatgattgttaactatagtccatagtttacatgagggctcactctttgtgttgtgtacttctatggttttgacaagagtataataacacatatccactgaaagggatcagaatatgctaccccaaaatattctactttggcataagaattattttgagctgaaggcaatttagaagcagcag

SEQ ID NO: 80851 - DNA, 3415 bp, Homo sapiens
  misc_feature (1133)..(1133): n is a, c, g, or t
  misc_feature (1154)..(1154): n is a, c, g, or t
  misc_feature (1674)..(1674): n is a, c, g, or t
  misc_feature (1805)..(1805): n is a, c, g, or t
cgcatcccaggaagaaggagttggagctccgtgatgccattcaaaaacagatgagatggggacagatttaacccaaaggacatagttcaactcctggtcttgacagaggagaagccctcaaagatggagtctcactctgttgccaggctagaatacaatggcacgaacttggctcactgcaacctccgcctcctgggttcaagagattctcctgcctcagcgtcctgagttgctgggactacgggcacacaccatcatgcccagctaatttttgtatttttagtagagacagggtttcaccatgttgaccaggatggtctcgatctcttgacctcgtgatctgcccacgtcggcctcccaaagtcctgggattacaggcatgagccagtgcgcctagcaaacgacagctttttgagcctctgtttaacaatctcttaaaccttataggtaggcagttctgagacagctcctaatcatctcccctcctggtattcaagccctgatggaatactctcttcttcaatgtgagctggacttagtggttttcttctaatccattgaatacacacaagtgatgagctgtcatttccaaaattagttcacacaaagctgtaacttttgttttgttcacagcctctctcaattgccttctcagcttgtatgctttgaagaagcaagctgcagtgttggagaggcccatgtggcaaggaaatgagggtggcctccagtcaatggctggtgagaaactgagaccttccttccaacaattgtcaagtaactgaatactcccaacaatcatatgggttaggttagaagtgaacctttctctagttgaggtttcagataagaccacagatattatactaacaccttgattgcaggcttatgagaaaccttgaaatgagaagactaagtaaaaccatatctggattcctgacttacagaaactgtgtgatgataaatgtgtgttatcttaagccacaaagtttttggggtgatttgttctacagcaattgataatgaatacttcaacctatagtgacaactggatgtctatttactcattttccccaccaaagtgtaaagttcctacaaggcagaggttacaacatattcatcctgctacctctcanagcccataatatacaacctgncccataaaacatgattaatcaatgtttgttaaattaacatgtattttgagtttcattgaaatcagttagttgaagtgataataacatttaaatgtgcatgagcagtaggacaaggcagatagctggttaggatagaaagtttttgaaaattgtgaggggaaaaattatttctatttgtaccctgttgtacccagcttaggtttcaaaaactttcagggggtttttattcatttaccaaagacttcaaagttggtgcctccccaccactctaaagaggtctttgcccttattgacccaaccatactgatttgcctggtgcacagtgggagctattataaggagaggggagaagaaggaaatagaaacaactgtgaaaaaggttgaaaaaaatagcgaaaaggatagaaaaagagcagaggaaagagaagaagtagtcaacatccaacccagatgcagagaaatgattcaaaagaaaaagtctgattttcctgtcggaaatatttttaaaaggaggtaggcntttatcaaaaaggaaaaaaaaaaaaaaagaataacagagtttgtcttccaaaggacccaatactcttggaattcaatgacctaattctgtgtatggttgcagtgtggagattgcctcttgtctgatctcanggcattgagacctctgatttctcaacagcacatgccacagcactatcagaagtcaggaataaagaacagagggtgtggggggcagtctagatattatgctcagcaaacatatttttaaatcagtgtaaattctatcttgctggttgcttatcttagcagttaaatcaacttttcgttacttttgtagacattatataatatcttctccccgcagctccagccaccagctgttagtcagcagaatgggagagggactgggtcagcttaagctgaataacttccatggtgacatttgagggaaccaattcccagccactgaacaaacctaaatgttctgctatggccatagaaccaaatagatcttaacaaagaaacctgagagcattcaaaggtcaaaacaattggagctagttccttcaagcttaaatatgctcatctgtaaagtggggacaataactgtgtgtcttatagggttattttgaaggctaaatatgtgtaaaagcctcagtctactgaaaggttgctcaactgtaacactcttttcattttgtgagggatcattctttgttggaggttagggacactgtctcgtgcattacaggatgtttagcaacatcctcagcttctatccatcagatgttagcaccccccccacggaccaccatcttctccatcatcaccatcaaatatgtctccagacatttccaagtgtcccctgggaggctaaaactgcccctggttgagaaccactgttctagtacttggcattgttccataaacatcagatgatatttttatcattataattattactaaaggcaacatcaccctgctatggagacaggtccttggtctcacggaatccctgcaatagttgctgcatttctgcatctttctgagagtaagggttgaaaagagataaggtcaattcatctgacaacaatccaatgggaaacctactgtctccgtagaaattcttttcatggaaagaaaaggggctaccattttgatctgctgcaggaactaggtctattcctcagcctcacagtttgcaaaacgctacagacttttccatgggcataaattctccagctttagggattgctggtatagttgactcttgaagctgctcttggatttccaagggtagcaccatttttacctgagaaaagaaggaaaaagatattcaagaaggagaacttttcaacagaagttactccatttgctgtttttgtggttttgtgcttgtttaggtttgcaagtgtgttttctgcccaaattgttcttgcatattctaacagtgtttgctttacgtgttttgatgccacgctgttttgaaggtacaaatgtttttcatggcatgtcttgtgttaagtgtacaaactgagacgtgaatgtcagtgactgaatagagtacagtattcctcaaagtttgtaactaaataaaccctaagagaaaagtgaagcgagatttctggaggtctggaagtggccagctgacaatatacatctctgtatctcctatttttatctttatgctaaatgcaaattttactttctgtgctaaaataatgtttcattagtttcaaggtaaaaatgtgtaaatagac

SEQ ID NO: 80852 - DNA, 3538 bp, Homo sapiens
  misc_feature (1256)..(1256): n is a, c, g, or t
  misc_feature (1277)..(1277): n is a, c, g, or t
  misc_feature (1797)..(1797): n is a, c, g, or t
  misc_feature (1928)..(1928): n is a, c, g, or t
cactgttgcggcttcatgtttcatcatgactagagatataataccttaagtagttagccaccaacactccaatcgcaaattctggaggtctgggattattccacaaatcactgggtagatgcaaaccttctagagaagtctagtatcagcagagtaaaacaatctccttttaaaaataagatttctttatcactccctgctttcacgcaatcacagcttctttttatttacttatttattttttagatggagtctcactctgttgccaggctagaatacaatggcacgaacttggctcactgcaacctccgcctcctgggttcaagagattctcctgcctcagcgtcctgagttgctgggactacgggcacacaccatcatgcccagctaatttttgtatttttagtagagacagggtttcaccatgttgaccaggatggtctcgatctcttgacctcgtgatctgcccacgtcggcctcccaaagtcctgggattacaggcatgagccagtgcgcctagcaaacgacagctttttgagcctctgtttaacaatctcttaaaccttataggtaggcagttctgagacagctcctaatcatctcccctcctggtattcaagccctgatggaatactctcttcttcaatgtgagctggacttagtggttttcttctaatccattgaatacacacaagtgatgagctgtcatttccaaaattagttcacacaaagctgtaacttttgttttgttcacagcctctctcaattgccttctcagcttgtatgctttgaagaagcaagctgcagtgttggagaggcccatgtggcaaggaaatgagggtggcctccagtcaatggctggtgagaaactgagaccttccttccaacaattgtcaagtaactgaatactcccaacaatcatatgggttaggttagaagtgaacctttctctagttgaggtttcagataagaccacagatattatactaacaccttgattgcaggcttatgagaaaccttgaaatgagaagactaagtaaaaccatatctggattcctgacttacagaaactgtgtgatgataaatgtgtgttatcttaagccacaaagtttttggggtgatttgttctacagcaattgataatgaatacttcaacctatagtgacaactggatgtctatttactcattttccccaccaaagtgtaaagttcctacaaggcagaggttacaacatattcatcctgctacctctcanagcccataatatacaacctgncccataaaacatgattaatcaatgtttgttaaattaacatgtattttgagtttcattgaaatcagttagttgaagtgataataacatttaaatgtgcatgagcagtaggacaaggcagatagctggttaggatagaaagtttttgaaaattgtgaggggaaaaattatttctatttgtaccctgttgtacccagcttaggtttcaaaaactttcagggggtttttattcatttaccaaagacttcaaagttggtgcctccccaccactctaaagaggtctttgcccttattgacccaaccatactgatttgcctggtgcacagtgggagctattataaggagaggggagaagaaggaaatagaaacaactgtgaaaaaggttgaaaaaaatagcgaaaaggatagaaaaagagcagaggaaagagaagaagtagtcaacatccaacccagatgcagagaaatgattcaaaagaaaaagtctgattttcctgtcggaaatatttttaaaaggaggtaggcntttatcaaaaaggaaaaaaaaaaaaaaagaataacagagtttgtcttccaaaggacccaatactcttggaattcaatgacctaattctgtgtatggttgcagtgtggagattgcctcttgtctgatctcanggcattgagacctctgatttctcaacagcacatgccacagcactatcagaagtcaggaataaagaacagagggtgtggggggcagtctagatattatgctcagcaaacatatttttaaatcagtgtaaattctatcttgctggttgcttatcttagcagttaaatcaacttttcgttacttttgtagacattatataatatcttctccccgcagctccagccaccagctgttagtcagcagaatgggagagggactgggtcagcttaagctgaataacttccatggtgacatttgagggaaccaattcccagccactgaacaaacctaaatgttctgctatggccatagaaccaaatagatcttaacaaagaaacctgagagcattcaaaggtcaaaacaattggagctagttccttcaagcttaaatatgctcatctgtaaagtggggacaataactgtgtgtcttatagggttattttgaaggctaaatatgtgtaaaagcctcagtctactgaaaggttgctcaactgtaacactcttttcattttgtgagggatcattctttgttggaggttagggacactgtctcgtgcattacaggatgtttagcaacatcctcagcttctatccatcagatgttagcaccccccccacggaccaccatcttctccatcatcaccatcaaatatgtctccagacatttccaagtgtcccctgggaggctaaaactgcccctggttgagaaccactgttctagtacttggcattgttccataaacatcagatgatatttttatcattataattattactaaaggcaacatcaccctgctatggagacaggtccttggtctcacggaatccctgcaatagttgctgcatttctgcatctttctgagagtaagggttgaaaagagataaggtcaattcatctgacaacaatccaatgggaaacctactgtctccgtagaaattcttttcatggaaagaaaaggggctaccattttgatctgctgcaggaactaggtctattcctcagcctcacagtttgcaaaacgctacagacttttccatgggcataaattctccagctttagggattgctggtatagttgactcttgaagctgctcttggatttccaagggtagcaccatttttacctgagaaaagaaggaaaaagatattcaagaaggagaacttttcaacagaagttactccatttgctgtttttgtggttttgtgcttgtttaggtttgcaagtgtgttttctgcccaaattgttcttgcatattctaacagtgtttgctttacgtgttttgatgccacgctgttttgaaggtacaaatgtttttcatggcatgtcttgtgttaagtgtacaaactgagacgtgaatgtcagtgactgaatagagtacagtattcctcaaagtttgtaactaaataaaccctaagagaaaagtgaagcgagatttctggaggtctggaagtggccagctgacaatatacatctctgtatctcctatttttatctttatgctaaatgcaaattttactttctgtgctaaaataatgtttcattagtttcaaggtaaaaatgtgtaaatagac

SEQ ID NO: 80853 - DNA, 460 bp, Homo sapiens
cgcatcccaggaagaaggagttggagctccgtgatgttctggaagctgagaagtctaaggtcaagactccagtggattacgcatctggcgagagcctacttcctggtttgtaggtggtgtcttctctctgtgtcctcacatggcataagggaaaagggacccctctgggatctatttttataagggtactaatcccctgcatgaggctccagcctcacaatcatggcagaaggcaaggagaagcaagttacatcttacatgggcagcagcagccattcaaaaacagatgagatggggacagatttaacccaaaggacatagttcaactcctggtcttgacagaggagaagccctcaaagcctactcaatgtgaagacaataaggatgaagaccattaatgatgttctgcttccacttaatgaataataaatatattttctcttctttatgattttcttaa

SEQ ID NO: 80854 - DNA, 576 bp, Homo sapiens
cgcatcccaggaagaaggagttggagctccgtgatgttctggaagctgagaagtctaaggtcaagactccagtggattacgcatctggcgagagcctacttcctggtttgtaggtggtgtcttctctctgtgtcctcacatggcataagggaaaagggacccctctgggatctatttttataagggtactaatcccctgcatgaggctccagcctcaagacctaatgtattgtccattttcatgctgctgataaagacatacctgagactgggcaatctacaaaagaaagaagtttaatggacttacaggttcacgtagctggggaagcctcacaatcatggcagaaggcaaggagaagcaagttacatcttacatgggcagcagcagccattcaaaaacagatgagatggggacagatttaacccaaaggacatagttcaactcctggtcttgacagaggagaagccctcaaagcctactcaatgtgaagacaataaggatgaagaccattaatgatgttctgcttccacttaatgaataataaatatattttctcttctttatgattttcttaa

SEQ ID NO: 80855 - DNA, 497 bp, Homo sapiens
aattaaaattaccgacttagaagatgataaatgctaagtaaaagtagaaggagaaagttgaaattctattaggattaagacagtgttatttaaaggcacatgcacccatttagtacctgcctaaatatttgcccttgtgtaagagcaaactcatttcagaaatatatcctgaattccaccagggtgatggttcaaattgttaaataaacctactctgaaagaagggtccatgttcctattctctctctgcagtgttgggaggtgatgttaacactctacatgttttgtatctgacccaatcatttcttccattctcattgcttctctcttaaacctcattgtatctctttactgtcattttctcccaattgtcttcttttgtctacagtgtgctcctaaaccagcagtctttggtgcctgttaaggctctttccttgtaggttttcttttatcaacctcgatctggcacacccgatgcggggacctctgaacagcta

SEQ ID NO: 80856 - DNA, 587 bp, Homo sapiens
aattaaaattaccgacttagaagatgataaatgctaagtaaaagtagaaggagaaagttgaaattctattaggattaagacagtgttatttaaaggcacatgcacccatttagtacctgcctaaatatttgcccttgtgtaagagcaaactcatttcagaaatatatcctgaattccaccagggtgatggttcaaattgttaaataaacctactctgaaagaagggtccatgttcctattctctctctgcagtgttgggaggtgatgttaacactctacatgttttgtatctgacccaatcatttcttccattctcattgcttctctcttaaacctcattgtatctctttactgtcattttctcccaattgtcttcttttgtctacagtgtgctcctaaaccagcagtctttggtgcctgttaaggctctttccttgtaggtttttaaactaaagatctatctgggaaacagatttggggtaggtcctgccagagtaatgaccatggtaggtgggaggaatatatctggctaccatacaaggtacttcagaagtaccattatggtttgcccagggccaagtggggag

SEQ ID NO: 80857 - DNA, 866 bp, Homo sapiens
tttagtcaggggtggggagtgcatcttagtcccagctactctactgaggaggctgaagtgggaggatggcttgaagccaggaattggaggctgcagtgagctatgatcatgccacggcactccagcctgggtgacagagggagatcctgtctctataaataaataaataaataaaatcagctcaactatttatgtcagtgtcgtaaatacagaaaccaaatccttaagatgccctagaagtggaggttgggtgggagggaatatcctccccaaacttcaaatcacatccatgctctgagagctccattgggttgccaagctccattcagtctcattttcctcttaacaatgcacgtgcgcaaaggcttcctgcctgggaaggcaccaggcatctttttaaagaagtgcaaggattttagatgaggtcaggagttgggcatgggagcgaggtgaagggtgaaaaaagttaagctactctggtgtaaaccaccacaaactccctgttcctgcttttattccttccctaaaacgttttcactttgggagaagaaaattttaacaaatcattattattaataaaaagctgtaaagtgggctgcacatggtgctcatgcctgtaatcccagcattttgggaggccaaggcgggaggatatcttgagcccaggagttcaggaccagcctgggcaacatggtgagacctcgtctctacaaaaacaaacaaaattagccaggtgtcctggctcgcactactccagaggttgaggcgggaggattgcttgatcccggcaggtcaaggctgcattgagctgtgatcacaccacttcactacagcctgagcagcaaagggaggactctgtcttccca

SEQ ID NO: 80858 - DNA, 602 bp, Homo sapiens
ctccctgtgcctcaggttcttgcagagtggaaatgcccacttcacagaatggctgagggtgtggatgaacggtggacgctcctgcccggcacccatgggtgctcacgacgattgtgttttactgttggctgcaatatgtcatgacttatcatgtgtgatccttgagtgaataggcagctgcgagcctgagcggactcctatgaaccagtcttctccagcaatagaccctccttcaactcgtggtagcctgtacgccaagggtgacagactggaaagcaggatccaccggttcatctatgggaaaaggagggggaatgagatcaaggattgaggacgctaatggagatggggtttcaccatgttgcccaggctggtcttgaactcctagactcaagtgatccactcgccttggcctcccaaaatgctggaattacaggagaaaagcagtccttctggtactggctgggtgtggtggctcacacctgtaatctcagcactttgggaggccaagacaggagaattgcttgagtccaggagattgagaccagcctgagcaacctacggagacccccctctctaccaaaaaaaaaaaaaaaaaaaaa

SEQ ID NO: 80859 - DNA, 921 bp, Homo sapiens
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggatgcagacaacatatgttttacagagtcttcatttgaggattccagaaatttcaaatattacaaccactcctcacacgaaaagcaaatgcagattcatttggaaagaaatcttttcccagttccgttgtctctaaactgaag

SEQ ID NO: 80860 - DNA, 642 bp, Homo sapiens
agggcatccagcttaacaaaaagatccctgcttccaaaagcaaatctctttaaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatccaaaatctctctactctctatatcctgcagctaagtgtaccccctagtt

SEQ ID NO: 80861 - DNA, 443 bp, Homo sapiens
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgtcgtcaaacagctgttgattaccgggggaattttggcttgcatcatgccttgttgctattgttc

SEQ ID NO: 80862 - DNA, 2674 bp, Homo sapiens
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatcca

SEQ ID NO: 80863 - DNA, 2616 bp, Homo sapiens
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatcca

SEQ ID NO: 80864 - DNA, 2505 bp, Homo sapiens
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatcca

SEQ ID NO: 80865 - DNA, 3123 bp, Homo sapiens
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaagagccagcatcctgtccctttttgaaaatagccagtgagggggaggcgcaggcactcaggagatggctgagtgagcggaggtgttttcacgtggatggcctgtcccgagctgcctgtccaccgctccttccacagcactgctctgtgctgcttgcatcactgtgtttccttacatcatgaacggttttcaggagacaagcaggcctctcttctcatcccaggggccaagcctgccctggccacagcccagcgagcagctgctgcagccaccgctccttacggggacgtccttgacagacaagcaccttctccacgcccgtccagctcagtcttcgtgaggcagctgaatctgtaccccaagcttccctttctttaacttggtggtgtactttcgttttcttttcctaacagcaccttttctgatacgaaaaagacaagatagatagtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatcca

SEQ ID NO: 80866 - DNA, 2620 bp, Homo sapiens
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccatcctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatcca

SEQ ID NO: 80867 - DNA, 2053 bp, Homo sapiens
cggagtacaagtcaggtcggtacccagcagcatagatattaccggctctgaaagaagctgagaacaggtacgcttctggtttttcaggcccctcttgttaatgtaatttctcctttggataactggccattctttttcaaaattgatctccagaggactttacgatgaccaaatcattgacctgtctgttttcaaacttgagccattgtctatttctgggagtcactgtgtgtcgcatctgagtctagcttaggggaggggcaggatgcttagagtgtttgagagcacagttggtccacatataatgatactgttttttatacctagatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatcca

SEQ ID NO: 80868 - DNA, 2625 bp, Homo sapiens
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgtttacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatcca

SEQ ID NO: 80869 - DNA, 2076 bp, Homo sapiens
catgtttaagacacattcagaaaccagctcatctcttcctttgatacattgcccagctgtcggccctggtgtgttgggtgtgtcagtgacccatgcagtgaatccagaattcacgatgttcaggctgtgtcatagtgcaatctgtgatgctaaaaagtgcacaggttccatagccaagttacaaagacgctcacctcaggattcgataaagagatagtcaggcgctcttttgttatcttcgcatctgccttcctcaacaatgcagttccaggccaatcataactataaatggaggaagttcccctgaagtagttgaggagaggaacactgcctcagaaaaggcaggaaggaaataacaccagaccggctaacacttgtttctggtggcaagaacacaggaaggtaattttttactttgcccagctgttctggtgtggggggattagcagtcacaggaggctgggttggcaggtttccccttgctcctgatttgcagccttgtcgtgcggccttaggcacactctccgtcgacactgtccccttcaccaccgcatgtgtgtctgcaggccacgcagggattttcctgagtactggggagctaccttttctagtttcctcagggaacctcctccttttaccttacagaagagagggatgggctgctaggggcaggtggggggctgcagacagcccacctccagagcccccggtggcgatgtatctgacttcagggagcttcttcagtggttttgaaagcaagatgcttgtgcattttggactacagagacaacatttgttactttttttatgactccagttaaaccttagtgggaaccagattaaatagtaaagtcttgaaaaaatacctgtagcagcgcagcttacctgccgctttccttttgttttctccaggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatcca

SEQ ID NO: 80870 - DNA, 906 bp, Homo sapiens
  misc_feature (28)..(28): n is a, c, g, or t
  misc_feature (31)..(31): n is a, c, g, or t
  misc_feature (88)..(88): n is a, c, g, or t
tttttaaaaaaaaccccctttttggggnccnccccaaaagggagcccgggttgtttggtttttccccttttcccaaccttgggggggnactaacccagagctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatcca

SEQ ID NO: 80871 - DNA, 2186 bp, Homo sapiens
  misc_feature (1864)..(1865): n is a, c, g, or t
  misc_feature (1867)..(1867): n is a, c, g, or t
  misc_feature (1901)..(1901): n is a, c, g, or t
  misc_feature (1918)..(1918): n is a, c, g, or t
  misc_feature (1947)..(1947): n is a, c, g, or t
  misc_feature (1949)..(1949): n is a, c, g, or t
  misc_feature (1966)..(1966): n is a, c, g, or t
  misc_feature (1972)..(1972): n is a, c, g, or t
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtaagaaagaaggggggcgggggggnnanaaaatttttttttaaaaccccccggggggggganaaaaatttttgaaaggnaaaaatttaaaagggcccccccctttggntnttccccttggaaaaccntgaacnagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttattt

SEQ ID NO: 80872 - DNA, 2005 bp, Homo sapiens
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaagagccagcatcctgtccctttttgaaaatagccagtgagggggaggcgcaggcactcaggagatggctgagtgagcggaggtgttttcacgtggatggcctgtcccgagctgcctgtccaccgctccttccacagcactgctctgtgctgcttgcatcactgtgtttccttacatcatgaacggttttcaggagacaagcaggcctctcttctcatcccaggggccaagcctgccctggccacagcccagcgagcagctgctgcagccaccgctccttacggggacgtccttgacagacaagcaccttctccacgcccgtccagctcagtcttcgtgaggcagctgaatctgtaccccaagcttccctttctttaacttggtggtgtactttcgttttcttttcctaacagcaccttttctgatacgaaaaagacaagatagatagtaagttacttttaaaaataaacatattacttgtgatcaatcataa

SEQ ID NO: 80873 - DNA, 1810 bp, Homo sapiens
gcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcagcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggagacaagcaggcctctcttctcatcccaggggccaagcctgccctggccacagcccagcgagcagctgctgcagccaccgctccttacggggacgtccttgacagacaagcaccttctccacgcccgtccagctcagtcttcgtgaggcagctgaatctgtaccccaagcttccctttctttaacttggtggtgtactttcgttttcttttcctaacagcaccttttctgatacgaaaaagacaagatagatagtaagttacttttaaaaataaacatattacttgtgatcaatcataa

SEQ ID NO: 80874 - DNA, 419 bp, Homo sapiens
ttctacagcagaatatacttggaaaaactctctagcatttgttggaatttagtgtaattaagtgaaacctacctagcaactgtagtaattaaaagcgtggggtgtgctttttgttgagatccgtgaatgtttctgtaaacacaattttgattgtgttgcgcttcttaaaggttgtgatgacaacggtaattttaaccacttgaccgtatatggttttcatccttgaagactgtcatatattttcaagtgtctttcctccctgttattttaggttaaagatcgaggtccggaagccactaggagattttttaattggttttattggagcattaacctgggagcgatcctgtcgttaggtggcattgcctatattcagcagaacgtcagctttgtcactggttatgcgatccccactgtct

SEQ ID NO: 80875 - DNA, 180 bp, Homo sapiens
aaagttgctcgtgtgctgccattcccgcatggcccgccacagtccctcctccagcgtcatggtgggcttccgccgggccagggatcggagaactgggctgtaaaccagtgcagtcagtcccagtctgtaagcccaccctccatcccgggcccacctggtcccaacacctggctcctgtcc

SEQ ID NO: 80876 - DNA, 913 bp, Homo sapiens
ctctcctgggccgtttcatctcaccgagagcgagatccgctttcctagaggctgggaggaccaggcccgggcacaggactggcttcgcaccactggccccgcagtcgggtccccggggacgcgccacgggtcactgctgcctgctaaagcgacacaaggcgccttcattcctcaggccgaggcggccgaacgccttggctctggccgacagtgagcacccactgcgagtccgcacacactgcagcgcccccgggcacgccccgcagtccgcccagcgtcccccggggcggggcacagccagaggacggcccgagagccctgctgtccccgtcagcgccgcaggagggcgcgacttccccgctgggccgaggcctttgccgggccctctactgtacgccggtcctagggctgggaccgccgtcctggaccgacctcagcccactgttctgcggaggccgcgtgttgggcgacagcagccacccagcccggaagcagccgttccgagcgcaggggcgccaagagccccgcgccccgcctgtgcgccggccctgagacttggaacgatggtgcaggcaggaggggtcaccggtagggatgccactggagggactgggccgtccacacggaccagctgacacactaagtgctgggtacacagcaggacaatggcaagggctgctcagactgcgtttttaaaatcgcctcaccacgaaagacagaaagtagggaagggtaccttgctgtggccaaggccgccctcgctgagtcagctggcattcccacgactccacgagtccccaaagggcttgtcagagcccagcggcaccctcgccctggaagtgccctgcgtcctcctcaagagccttatttgggacagagatcagatcaaccgcgccaccaccctcccacccac

SEQ ID NO: 80877 - DNA, 289 bp, Homo sapiens
caggcttggcattggagtagatgctttaaaaaaaaaaaaaaggaatgatacgctctaccttgcaagtttttcagagagacaggacttgtgtgtgtgaaaagtgcaatagagtttgcaaggcagcatacagtcccattagcatttgtattgcttcatatttctagactaagtgatgttgcagaacaccagtattctgttctatacaatccgttcacatttctaagagcatgagcgttcatttgtcttttcaattgtttcccactttctctgcatacacaatacttgctgg

SEQ ID NO: 80878 - DNA, 698 bp, Homo sapiens
aaaagaaaaaaaaaaaaaaagcatggatgatataatactctcacccttcctgttaaatttcaaagtccctaaatacttcttgactgtggtgtggaggcttccacaatgctctggggagctggtcagtctgccctgggtgttttttctcagaagggcctgggaattccagctcagatcctgccctgctgggaggcacctacccctgcaggatgccgatcatcagtctcacaagactaaacaaatctctccctctccccgcaggctgcctgggttgcacaacacaccgttttgggcctaggaaggccatctctttggtccttagattcagatttttggggtttctattgtttatttcctcttccctctaccttttaaaaggaggtagtgtcggctgggtgcagtggttcacatctgtaatcccagcactttgggaggccaaggcaagtggataacttgaggtcaagagttcaagaccagcctggccaacatggtgaaaccccggctctgctaaaaatacaaaaattagctgggcatggtggtgcatgcctgtagtcccatctacttgggaggctgaggcacgagaatctctggaacctgggaggcagaggttgcagtgagccaagatcgcaccactgcactccagcctgggtgagagtgagactccatctcaaaaaaaaaaaaaaaaaagggaggtcgtg

SEQ ID NO: 80879 - DNA, 758 bp, Homo sapiens
cacagtccggctggaaacaagctccccccaatttcagggccgttgtcgcctccgggcggtccgcgggtcccgagcggactgggactctggagacgtgcccccaaccccaccgccattcaccctgtcattgcaggggagagaacagaataaagacgggtacattttccatctcacctctgaacctcggttaggaaaacgctgtagccctgactagtgggctcaagggccgactggaaaagggcgagtcagcgttcaaagccgattcggggcagccctctctaacgcagagggccgaggataagaagacgacaatgtgttaggggccctccgggctaggactgtcctcaccactttgtacattgccaaagtaaatataacgtagaggtcaagcgcaggcgctttgtgggcagacatgactgagctccactcgcgactcctctaatggcgtgccagctgcggacctcattagccccgcctcaatcattcagtatgttttggttgtctacagtgtacgaagccctgttctcacaattagataaaatgagtgtgaagtgctcaacataattcctagtgtagtaggccttcaaagaactattatcattattaattactcatatagaatacaactttatgaaatgataggatcccattttaagatgaggaaaatgaggctatcagagacgttaaggaacttaatgtcacacagttaataaacgatagaggtgcgatttgaacacaggttgtctaataccagacct

SEQ ID NO: 80880 - DNA, 185 bp, Homo sapiens
ttctataataaagattatttagttgaggggagggacaaatttgtagtttccaactaaacaaaataagtgtgcattaaaagacaaaatcaagtcatttttcggatttttactaatgcctttaaatagcccaaaagttgaaccagaggcccactttgccagagaatctgtccacagccaggcagggc

SEQ ID NO: 80881 - DNA, 789 bp, Homo sapiens
ctttgacatatctttttggggaacacagtacaacccacagcacctggagaactgaatgtaggtgcctgttgttggaacataacttgtgaggggtgtaatggaaggaagggggtgaggttgtaaggttataatggcctctttttgtcccttcccaacaatctccagcttctgggtttatgcttgacctaggataagccctcagggcattccagtttctggccgtgctgattgttttgaaatgggtttatgattgattttaatggactcaatcagagtgaatctcaggacttttgtcggagatccctttcctctgtgggcgtttagaaggacatgtgttgccttcttttctgtgtggcgaggccataatgcctagaactgttaagagttagcgttgctgctgtaaggaattcacctcaggtcagaacaactcccagaagatggaggatggcagagaaatggagccggagacctgataactttctgaatctctggatcaaaacttgcctgaaggtgtagtttttggtttgtgaagtactgcagtccatgtttttcttaagccggttagagttggatttccttccacttacagtagaacaattcctaacatacagagggagggaggtagagccagctgactagggttagtcagttagggcttctgtaacaaattaccatagactttacctcgatgaaaggttcccaagatgggcagatgctttttatttaccgcagtatagaggacaggtatgtacgcaggagaaaaaggagagtgtgtgtttatgatcagaa

SEQ ID NO: 80882 - DNA, 498 bp, Homo sapiens
gttacctacatagctccaatgctcaaaacacctccaaatgtcttttaactatggcaactaaactagatccttctgcccagcttttcagacccaccacaatctggcctcacactacagtcagttcccattaattcccaccactcagccttggtcctccatcagacaaatctctgcactgtcttaagagctgctaagcccattcccgcttctttgcctttgttctgtcccctggctggactattttccatgctactattctaatgccgccactcattctttagtgcccagaaaagtcctacattctttgtggaacatatactaactattcattcattctctctctctctctctctcactctcggatcttgctctgtggcccaggctggagtgcagtggcatgatcacagttcaatgcagcctcaacctccagggctcaagggatcctcctgtttcagccttcagtagttgggactaaaggcgcatgccaccatgcccagc

SEQ ID NO: 80883 - DNA, 188 bp, Homo sapiens
tggccctgtggggtggaccaggggtttctccccagacgcctgttggggccagggctgccccctcagacctccaagacgtcgagtgtggaggacaccctggaggaggagatggaaccctcctgtttgctggggctcggcccccggtgaggctggctgcaggtgaccacagagacctagcctggtgtcgt

SEQ ID NO: 80884 - DNA, 366 bp, Homo sapiens
gttttactcaaccaggctttgtgtggaggtattcactgcaaagaagttttgcctgtaactgtcacagctagaatctataacctcatatgaaaacaaaaaaaggaaaaacatatggaaatgtgttgggactttgtctcaattgtgcttaagctaaactttctcagtttttagctggcaacttctattgaatttgtggtaattttgttaaaagttaataccagtctttttaatgatttgactctaagttttgaaactaccaagttagttaaacctttcatatcaaaaggacatattttgggctatttcttttccaatattctgcaatattttgatttgtggacagattccatgctgacagaaaacaac

SEQ ID NO: 80885 - DNA, 371 bp, Homo sapiens
acttccaaattgaactagatctaacagcccaagaaaacaggattaccgctatttacatatgacttaatcacacttacagactggttgtcctttaagcaaaactccgttttggcagatgtgcatagaaaaagccatcagctccaggacctattcaacatgctttcaattaactaaagctgcagcacagtaaataatacttcaggaacctcaaagagaatgcatcttccaaagggccccatcttattggaagtggaggcatatttaggcactggaaacacttggctcaaaataattaaaggagaaaatggacttggaaaacctgtttactttagatctacttcccgactttgacatgctgtattagacctaat

SEQ ID NO: 80886 - DNA, 316 bp, Homo sapiens
cctggcatcatttctctaaaacataaaactggccattcctcatttccatagtctcccaattactaacacgtttataaagctcaataatgactgtcacgtttgtttagggagctaaaggtggaagtccaactttaaagcaggatttcaagtttcctgatcacattgaattctttttttggtctgtcctgtgtgtatgtcgatatcctgaaatttcagccccattggtactacgtgcgagacagcctttaaaatttctctgcctccagtgctgaaagccaggaaaaagaaactgaaagtgtctgccattgggccaggg

SEQ ID NO: 80887 - DNA, 839 bp, Homo sapiens
gctgctgctgctccagctctccggatctctccaacagctgctccagctccgagaacctcttcttgtactggagaatctggggattgggagctgatgagtcttactctgttgcccaggctgcggtgcaatggcgcgatctcggctcacagtaacctccacctcccgggttcaagcgattctcctgcctcagcctcccgagtagttgggattacagacacacaccactgcgcccggtaagtatgagatcttcgggctctgccccgacacagcctcatacgcctcactctttacacacacggtcacttgccccgcgcactcccgagccctttccagccctgacacacagctgggattctcacttccgatccgcggtcctgaacccgctcccagggcacgggaactccttcgtggcgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagccgccaaggggaagtgacgtctgcctctccctttttccctcccgcccctgcgtctgttctctcccaaagaagctggtccttagcctgtgttaaggagcaacctttcggtggccagatggagccggggcatccttcttcaaataatggcttttaattcgcagactagaatgtttcggattacaaaagaaaccggttctcttcacatccttatccttgtgatgcagcattccgcttgcaattggaagccgtttaatatcagagagaaaccatatttatgaaagtaaagag

SEQ ID NO: 80888 - DNA, 966 bp, Homo sapiens
ccttcaccctgactctgatctaaatactgattgaacatactctaggcagtaatgacttgatataagagatatactactttcagagttgtcttcacaactgtttgcccttctaaaattatctcctatttttctactcctattttgatgattgaatgagtgctttccaaagatgataaatacaagttaaaagccaaagtagtaaacttgtaagtgtgaagtctgtgttccctttgtcctgtaatcctatttcttataatttgcctaaaattatagtaagttgaaaaatgtatgcagaaagttcatttcagcattcactatttagtgaaaataggagaacaacctaaatctgtagcaataaagtaccaaattagcaaattatctgtacacaaaagaatattatgcagacatcaaaaataatgccatagttttatgtttattgatttgccaggatgtttgtgatacagaataatgtctgtgatgtattattaaataaaaagcaaattgcagagcagcatttatatgttcccatttgtgcaggattgtatacttatttctgcatgtgtattcatggagcactgtctgggaagtatgttaaaacattgattatagctagtggcagatttggagatttctttccttgctaattattcatgcttggaaccaatactatgatattgaaatatatctatcccttttagtgttttttataccatattaatgtaatttttaagaaattttaatatttaacatttgtgtttaataattatggctcttggatctctttttttaatttttatgttactgagcctgcaaaacatgaagaccacagttggtttctaatattgactctgccacatttcagtatcttagtattttaattatgtccttagcttatgtcttattagcacctcttccttagcttatgtattttctaagtataggaactgcatttgttaaagttgatct

SEQ ID NO: 80889 - DNA, 948 bp, Homo sapiens
acttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtagaaaagtt

SEQ ID NO: 80890 - DNA, 968 bp, Homo sapiens
  misc_feature (894)..(894): n is a, c, g, or t
  misc_feature (896)..(896): n is a, c, g, or t
acttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattctggcggggagtaaaaagcggtggtttggngncaagtttacggtggaaacgggggaaaagtggggaaccttgggacacaagggttttggggtgtaattggaaag

SEQ ID NO: 80891 - DNA, 945 bp, Homo sapiens
acttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaaccgctgtcttcgttgttgaagcatataagcctagagaggcacgtgaagatatgtga

SEQ ID NO: 80892 - DNA, 740 bp, Homo sapiens
  misc_feature (620)..(620): n is a, c, g, or t
  misc_feature (623)..(623): n is a, c, g, or t
  misc_feature (631)..(631): n is a, c, g, or t
  misc_feature (633)..(634): n is a, c, g, or t
  misc_feature (651)..(651): n is a, c, g, or t
  misc_feature (656)..(656): n is a, c, g, or t
  misc_feature (660)..(660): n is a, c, g, or t
  misc_feature (696)..(696): n is a, c, g, or t
  misc_feature (702)..(702): n is a, c, g, or t
acttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcatttgggtaanctnggttgggngnncccaaaattttttgaanccctncctncaagtaatccccataataattccctgggaaccattntttccnaaaaggcctttaagggaacccatttaaggaagtttgtt

SEQ ID NO: 80893 - DNA, 4448 bp, Homo sapiens
acttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtaccagtcacagggctattttcctgaatattgggtgatgtcaaaggtatatgatacttgaggaaatcaggccaagtgtagctgagcaattaataaacactcaagtttttttagttggggtcatgtcaaaccctcacatggtggttaagtagtgactaactgtgcatgtccttcatggtaggtgagcaccagtctccatgatcaaaaatgccccagtttcctttgaaaaagccactagttctgtgaattgtccttttccctcctgcccctaacagtcctacccctctagcctacattagcatatttctcatgtaatgtattttgctggtaagctcatccattagctgcgtccttcagctattcctttagattggaggaagtggatatgaagatggattgattcagctcaccttccatgattgcttttgagggaaaagctacagtggccacatttcagatgttcacttttgcaatttgtggagggtggagagaggtagacttttgttgtgtgttttataaagtactctcagtaaggagtgtttgagttgaagagtcatctgattcgaggccactcatgttctttgtaacttaaactttgaccaagaaattcttcacttctcacttcttcacttcttcccaatatacagtaagtacgtgagccagtcatccatacactaaggcctagttgagaaaaacctttgattcaggatggctgggttactaaccttgaaatgtaagagatctggttttgaatgtaaaagttgcaacacacaaacggaagtcttaaaaactttttgctctggtcagttacaggtggatccccaataatctgtttttggttttctgatggaaataatagaattaggggaaatcaaatctggttggtaggtgtctacagtattagaagagggtataagggcactgtttaacactaagttctaatacttccagaaactgtgcattccagatctacatactaaatgctcttatcattttgaaatgggctcttgattaatagacccatattttttagtggcttctatgttgtatatttgtctaaaatgaaagctcttttgcgttctaaaactacaatatatgtcatcttattttccctgagtatccaagtatagtgcagattctatgtaaaactactaaatgacactggaatatgtttagtagattagggggaaaaactataaaggtttatacaattgtttgtagttacatttaggatggacttatccctttggagaagagtgaagtttgttttttcgccatgtgatgaagaccactgtgattttttaaaaaagtagataatacttaaaatggcgtaataattctgcacttgaatttgtactgttaacagcacatttggaagattttaaaactttttattgtcttataaatagcattcacttattattttggatatttaagggttccattaagttaacactgtatttggacaaagtgtgaccaaattagccagtctgttttcttccatgtttaattagaagtgagaggtagaagtacttcaaattcaacaggccagcaagcaatcggcttaaaattccctttcttaaatgttgtgctcttatgttctcggctttttaatgactttatttttacagtacttgttcagtcacttgagatgaaatgcttggggtagcttttccatcctcaaacttaatgtttttactagttcatagtgtttggaacagtatatgccaatcactgagactgcatcagagtttgcaattttgtatgtttcattgccaaagaaggcttagtggttgttgactgtagtataagtcagctttctgtagcataagatttgattttcccatacttacttcacttgttatacatcactgattatttgggttaaactggactcatttcaagcagtttgcttttgttcaaatcgtgatgagaaacctaatactgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtaaaaatagagataagttgggaagatatattgattatgctgttctgttgagggaaaggtcatgtatttagaaatttaaacttttggttattgtgttcacatcatagtattcaagcatcatttatagtttggttttgagaacttttctggtattacgtttatggcaaatgtataaaagaaacaagttttggttatatttttatatttgtaaagtaagtttggttaaagtgatcactgttctttttttattttattgtcatttcaataaaaaatatttgaaagaaaaaaaaaaaa

SEQ ID NO: 80894 - DNA, 4562 bp, Homo sapiens
  misc_feature (4562)..(4562): n is a, c, g, or t
acttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtaccagtcacagggctattttcctgaatattgggtgatgtcaaaggtatatgatacttgaggaaatcaggccaagtgtagctgagcaattaataaacactcaagtttttttagttggggtcatgtcaaaccctcacatggtggttaagtagtgactaactgtgcatgtccttcatggtaggtgagcaccagtctccatgatcaaaaatgccccagtttcctttgaaaaagccactagttctgtgaattgtccttttccctcctgcccctaacagtcctacccctctagcctacattagcatatttctcatgtaatgtattttgctggtaagctcatccattagctgcgtccttcagctattcctttagattggaggaagtggatatgaagatggattgattcagctcaccttccatgattgcttttgagggaaaagctacagtggccacatttcagatgttcacttttgcaatttgtggagggtggagagaggtagacttttgttgtgtgttttataaagtactctcagtaaggagtgtttgagttgaagagtcatctgattcgaggccactcatgttctttgtaacttaaactttgaccaagaaattcttcacttctcacttcttcacttcttcccaatatacagtaagtacgtgagccagtcatccatacactaaggcctagttgagaaaaacctttgattcaggatggctgggttactaaccttgaaatgtaagagatctggttttgaatgtaaaagttgcaacacacaaacggaagtcttaaaaactttttgctctggtcagttacaggtggatccccaataatctgtttttggttttctgatggaaataatagaattaggggaaatcaaatctggttggtaggtgtctacagtattagaagagggtataagggcactgtttaacactaagttctaatacttccagaaactgtgcattccagatctacatactaaatgctcttatcattttgaaatgggctcttgattaatagacccatattttttagtggcttctatgttgtatatttgtctaaaatgaaagctcttttgcgttctaaaactacaatatatgtcatcttattttccctgagtatccaagtatagtgcagattctatgtaaaactactaaatgacactggaatatgtttagtagattagggggaaaaactataaaggtttatacaattgtttgtagttacatttaggatggacttatccctttggagaagagtgaagtttgttttttcgccatgtgatgaagaccactgtgattttttaaaaaagtagataatacttaaaatggcgtaataattctgcacttgaatttgtactgttaacagcacatttggaagattttaaaactttttattgtcttataaatagcattcacttattattttggatatttaagggttccattaagttaacactgtatttggacaaagtgtgaccaaattagccagtctgttttcttccatgtttaattagaagtgagaggtagaagtacttcaaattcaacaggccagcaagcaatcggcttaaaattccctttcttaaatgttgtgctcttatgttctcggctttttaatgactttatttttacagtacttgttcagtcacttgagatgaaatgcttggggtagcttttccatcctcaaacttaatgtttttactagttcatagtgtttggaacagtatatgccaatcactgagactgcatcagagtttgcaattttgtatgtttcattgccaaagaaggcttagtggttgttgactgtagtataagtcagctttctgtagcataagatttgattttcccatacttacttcacttgttatacatcactgattatttgggttaaactggactcatttcaagcagtttgcttttgttcaaatcgtgatgagaaacctaatactgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtaaaaatagagataagttgggaagatatattgattatgctgttctgttgagggaaaggtcatgtatttagaaatttaaacttttggttattgtgttcacatcatagtattcaagcatcatttatagtttggttttgagaacttttctggtattacgtttatggcaaatgtataaaagaaacaagttttggttatatttttatatttgtaaagtaagtttggttaaagtgatcactgttctttttttatgtcattcataaaaattttgatacaaaaaaaaaaaaaaattgtgggcgggcccaaaatttaaactgtgggggggcgagaagaagggaggcaggaacgggaaaggggtttccaaaaccgggggggtaaacgggtggttgttacggagacttcacgggggtn

SEQ ID NO: 80895 - DNA, 4256 bp, Homo sapiens
acttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtaccagtcacagggctattttcctgaatattgggtgatgtcaaaggtatatgatacttgaggaaatcaggccaagtgtagctgagcaattaataaacactcaagtttttttagttggggtcatgtcaaaccctcacatggtggttaagtagtgactaactgtgcatgtccttcatggtaggtgagcaccagtctccatgatcaaaaatgccccagtttcctttgaaaaagccactagttctgtgaattgtccttttccctcctgcccctaacagtcctacccctctagcctacattagcatatttctcatgtaatgtattttgctggtaagctcatccattagctgcgtccttcagctattcctttagattggaggaagtggatatgaagatggattgattcagctcaccttccatgattgcttttgagggaaaagctacagtggccacatttcagatgttcacttttgcaatttgtggagggtggagagaggtagacttttgttgtgtgttttataaagtactctcagtaaggagtgtttgagttgaagagtcatctgattcgaggccactcatgttctttgtaacttaaactttgaccaagaaattcttcacttctcacttcttcacttcttcccaatatacagtaagtacgtgagccagtcatccatacactaaggcctagttgagaaaaacctttgattcaggatggctgggttactaaccttgaaatgtaagagatctggttttgaatgtaaaagttgcaacacacaaacggaagtcttaaaaactttttgctctggtcagttacaggtggatccccaataatctgtttttggttttctgatggaaataatagaattaggggaaatcaaatctggttggtaggtgtctacagtattagaagagggtataagggcactgtttaacactaagttctaatacttccagaaactgtgcattccagatctacatactaaatgctcttatcattttgaaatgggctcttgattaatagacccatattttttagtggcttctatgttgtatatttgtctaaaatgaaagctcttttgcgttctaaaactacaatatatgtcatcttattttccctgagtatccaagtatagtgcagattctatgtaaaactactaaatgacactggaatatgtttagtagattagggggaaaaactataaaggtttatacaattgtttgtagttacatttaggatggacttatccctttggagaagagtgaagtttgttttttcgccatgtgatgaagaccactgtgattttttaaaaaagtagataatacttaaaatggcgtaataattctgcacttgaatttgtactgttaacagcacatttggaagattttaaaactttttattgtcttataaatagcattcacttattattttggatatttaagggttccattaagttaacactgtatttggacaaagtgtgaccaaattagccagtctgttttcttccatgtttaattagaagtgagaggtagaagtacttcaaattcaacaggccagcaagcaatcggcttaaaattccctttcttaaatgttgtgctcttatgttctcggctttttaatgactttatttttacagtacttgttcagtcacttgagatgaaatgcttggggtagcttttccatcctcaaacttaatgtttttactagttcatagtgtttggaacagtatatgccaatcactgagactgcatcagagtttgcaattttgtatgtttcattgccaaagaaggcttagtggttgttgactgtagtataagtcagctttctgtagcataagatttgattttcccatacttacttcacttgttatacatcactgattatttgggttaaactggactcatttcaagcagtttgcttttgttcaaatcgtgatgagaaacctaatactgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtaaaaatagagataagttgggaagatatattgattatgctgttctgttgagggagaaaagaccctggggtaacgcgctcgaattcctgatcctagtctagg

SEQ ID NO: 80896 - DNA, 4239 bp, Homo sapiens
acttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtaccagtcacagggctattttcctgaatattgggtgatgtcaaaggtatatgatacttgaggaaatcaggccaagtgtagctgagcaattaataaacactcaagtttttttagttggggtcatgtcaaaccctcacatggtggttaagtagtgactaactgtgcatgtccttcatggtaggtgagcaccagtctccatgatcaaaaatgccccagtttcctttgaaaaagccactagttctgtgaattgtccttttccctcctgcccctaacagtcctacccctctagcctacattagcatatttctcatgtaatgtattttgctggtaagctcatccattagctgcgtccttcagctattcctttagattggaggaagtggatatgaagatggattgattcagctcaccttccatgattgcttttgagggaaaagctacagtggccacatttcagatgttcacttttgcaatttgtggagggtggagagaggtagacttttgttgtgtgttttataaagtactctcagtaaggagtgtttgagttgaagagtcatctgattcgaggccactcatgttctttgtaacttaaactttgaccaagaaattcttcacttctcacttcttcacttcttcccaatatacagtaagtacgtgagccagtcatccatacactaaggcctagttgagaaaaacctttgattcaggatggctgggttactaaccttgaaatgtaagagatctggttttgaatgtaaaagttgcaacacacaaacggaagtcttaaaaactttttgctctggtcagttacaggtggatccccaataatctgtttttggttttctgatggaaataatagaattaggggaaatcaaatctggttggtaggtgtctacagtattagaagagggtataagggcactgtttaacactaagttctaatacttccagaaactgtgcattccagatctacatactaaatgctcttatcattttgaaatgggctcttgattaatagacccatattttttagtggcttctatgttgtatatttgtctaaaatgaaagctcttttgcgttctaaaactacaatatatgtcatcttattttccctgagtatccaagtatagtgcagattctatgtaaaactactaaatgacactggaatatgtttagtagattagggggaaaaactataaaggtttatacaattgtttgtagttacatttaggatggacttatccctttggagaagagtgaagtttgttttttcgccatgtgatgaagaccactgtgattttttaaaaaagtagataatacttaaaatggcgtaataattctgcacttgaatttgtactgttaacagcacatttggaagattttaaaactttttattgtcttataaatagcattcacttattattttggatatttaagggttccattaagttaacactgtatttggacaaagtgtgaccaaattagccagtctgttttcttccatgtttaattagaagtgagaggtagaagtacttcaaattcaacaggccagcaagcaatcggcttaaaattccctttcttaaatgttgtgctcttatgttctcggctttttaatgactttatttttacagtacttgttcagtcacttgagatgaaatgcttggggtagcttttccatcctcaaacttaatgtttttactagttcatagtgtttggaacagtatatgccaatcactgagactgcatcagagtttgcaattttgtatgtttcattgccaaagaaggcttagtggttgttgactgtagtataagtcagctttctgtagcataagatttgattttcccatacttacttcacttgttatacatcactgattatttgggttaaactggactcatttcaagcagtttgcttttgttcaaatcgtgatgagaaacctaatactgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtaaaaatagagataagttgggaagatatattgattatgctgttctgttgagggaatggtccgcacagcgggatcctctaaagtc

SEQ ID NO: 80897 - DNA, 3849 bp, Homo sapiens
atgtcacactacgcattactctccctggcccgtccccacactcctctgtctacctcacattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtaccagtcacagggctattttcctgaatattgggtgatgtcaaaggtatatgatacttgaggaaatcaggccaagtgtagctgagcaattaataaacactcaagtttttttagttggggtcatgtcaaaccctcacatggtggttaagtagtgactaactgtgcatgtccttcatggtaggtgagcaccagtctccatgatcaaaaatgccccagtttcctttgaaaaagccactagttctgtgaattgtccttttccctcctgcccctaacagtcctacccctctagcctacattagcatatttctcatgtaatgtattttgctggtaagctcatccattagctgcgtccttcagctattcctttagattggaggaagtggatatgaagatggattgattcagctcaccttccatgattgcttttgagggaaaagctacagtggccacatttcagatgttcacttttgcaatttgtggagggtggagagaggtagacttttgttgtgtgttttataaagtactctcagtaaggagtgtttgagttgaagagtcatctgattcgaggccactcatgttctttgtaacttaaactttgaccaagaaattcttcacttctcacttcttcacttcttcccaatatacagtaagtacgtgagccagtcatccatacactaaggcctagttgagaaaaacctttgattcaggatggctgggttactaaccttgaaatgtaagagatctggttttgaatgtaaaagttgcaacacacaaacggaagtcttaaaaactttttgctctggtcagttacaggtggatccccaataatctgtttttggttttctgatggaaataatagaattaggggaaatcaaatctggttggtaggtgtctacagtattagaagagggtataagggcactgtttaacactaagttctaatacttccagaaactgtgcattccagatctacatactaaatgctcttatcattttgaaatgggctcttgattaatagacccatattttttagtggcttctatgttgtatatttgtctaaaatgaaagctcttttgcgttctaaaactacaatatatgtcatcttattttccctgagtatccaagtatagtgcagattctatgtaaaactactaaatgacactggaatatgtttagtagattagggggaaaaactataaaggtttatacaattgtttgtagttacatttaggatggacttatccctttggagaagagtgaagtttgttttttcgccatgtgatgaagaccactgtgattttttaaaaaagtagataatacttaaaatggcgtaataattctgcacttgaatttgtactgttaacagcacatttggaagattttaaaactttttattgtcttataaatagcattcacttattattttggatatttaagggttccattaagttaacactgtatttggacaaagtgtgaccaaattagccagtctgttttcttccatgtttaattagaagtgagaggtagaagtacttcaaattcaacaggccagcaagcaatcggcttaaaattccctttcttaaatgttgtgctcttatgttctcggctttttaatgactttatttttacagtacttgttcagtcacttgagatgaaatgcttggggtagcttttccatcctcaaacttaatgtttttactagttcatagtgtttggaacagtatatgccaatcactgagactgcatcagagtttgcaattttgtatgtttcattgccaaagaaggcttagtggttgttgactgtagtataagtcagctttctgtagcataagatttgattttcccatacttacttcacttgttatacatcactgattatttgggttaaactggactcatttcaagcagtttgcttttgttcaaatcgtgatgagaaacctaatactgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtaaaaatagagataagttgggaagatatattgattatgctgttctgttgagggaaaggtcatgtatttagaaatttaaacttttggttattgtgttcacatcatagtattcaagcatcatttatagtttggttttgagaacttttctggtattacgtttatggcaaatgtataaaagaaacaagttttggttatatttttatatttgtaaagtaagtttggttaaagtgatcactgttctttttttattttattgtcatttcaataaaaaatatttgaaagaaaaaaaaaaaa

SEQ ID NO: 80898 - DNA, 2410 bp, Homo sapiens
acttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtaccagtcacagggctattttcctgaatattgggtgatgtcaaaggtatatgatacttgaggaaatcaggccaagtgtagctgagcaattaataaacactcaagtttttttagttggggtcatgtcaaaccctcacactctctccacactggggaggtgatagcattgctttcgtgtaaattatgtaatgcaaaatttttttaatcttcgccttaatacttttttatttggttttatttggaatgatgagccttcgtgcccccccttcccccttttttgtcccccacttgagatgtatgaaggctttggtctcctgggagtgggtggaggcagcagggctacctgtacatga

SEQ ID NO: 80899 - DNA, 1894 bp, Homo sapiens
acttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagc

SEQ ID NO: 80900 - DNA, 782 bp, Homo sapiens
  misc_feature (12)..(12): n is a, c, g, or t
acccccttccancatctcatttctcttgttcagtcacttgagatgaaatgcttggggtagcttttccatcctcaaacttaatgtttttactagttcatagtgtttggaacagtatatgccaatcactgagactgcatcagagtttgcaattttgtatgtttcattgccaaagaaggcttagtggttgttgactgtagtataagtcagctttctgtagcataagatttgattttcccatacttacttcacttgttatacatcactgattatttgggttaaactggactcatttcaagcagtttgcttttgttcaaatcgtgatgagaaacctaatactgtaatttgatttgagccataaaacacattttaatattagcttgtattatagttattaagcttgtttttgtggaaaaaaacttactaaaacctaggtaactctagattaggccagttcaggtgtattttgtatcttagtaatggatcatatcgtaaaaatagagataagttgggaagatatattgattatgctgttctgttgagggaaaggtcatgtatttagaaatttaaacttttggttattgtgttcacatcatagtattcaagcatcatttatagtttggttttgagaacttttctggtattacgtttatggcaaatgtataaaagaaacaagttttggttatatttttatatttgtaaagtaagtttggttaaagtgatcactgttctttttttattttattgtcatttcaataaaaaatatttgaaagaaaaaaaaaaaa

SEQ ID NO: 80901 - DNA, 295 bp, Homo sapiens
gcggccgcctactactactactactgctcgaattcaagcttctaacgatgtacgggaaggtcatgtatttagaaatttaaacttttggttattgtgttcacatcatagtattcaagcatcatttatagtttggttttgagaacttttctggtattacgtttatggcaaatgtataaaagaaacaagttttggttatatttttatatttgtaaagtaagtttggttaaagtgatcactgttctttttttattttattgtcatttcaataaaaaatatttgaaagaaaaaaaaaaaa

SEQ ID NO: 80902 - DNA, 1893 bp, Homo sapiens
acttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaccctcttaccaattatacttttggtacaaaagagcccctctacgagaaggacagctctgttgcagccagatttcagcgcatgagggaagaatttgataaaattggaatgaggaggactgtagaaggggttctgattgtacatgagcaccggctaccccatgtgttactgctgcagctgggaacaactttcttcaaactacctggtggtgaacttaacccaggagaagatgaagttgaaggactaaaacgcttaatgacagagatactgggtcgtcaggatggagttttgcaagactgggtcattgacgattgcattggtaactggtggagaccaaattttgaacctcctcagtatccatatattcctgcacatattacaaagcctaaggaacataagaagttgtttctggttcagcttcaagaaaaagccttgtttgcagtccctaaaaattacaagctggtagctgcaccattgtttgaattgtatgacaatgcaccaggatatggacccatcatttctagtctccctcagctgttgagcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttggcacttgcggttggaccggct

SEQ ID NO: 80903 - DNA, 154 bp, Homo sapiens
ggatctctgtcttaaatctgtcaggatggccctgtggccacttctgcaaaaacccctggggacaaaatttattgttattcctcaatagctttttgttcacttccaatataggggtcctgggtcatgctaacgattgtggagagacaaaatgctc

SEQ ID NO: 80904 - DNA, 496 bp, Homo sapiens
agtatacccccttttaaagaaaatacatgtcaagtctttcatcttctgagaacaaaaactgtgaacaactttctgaatgggaaaatcactgggcattttgaaatatagttaaagagtattggggtaacttataaatggtgggtcagtcaactgcgtgtgttgtttacacaattccagtgactagttgggaagttgtttcctctgaaaagggacttgctcagctggaattgcttgctaaaaggctaggtttgttaaatagatttgtactctgttttgggaagccaaaatgtccctgaaactatactgttctgagatgacacagtttgaaattaggtgaaagcatttactatggagttgctcttaattaaatttgaaagatgagtcattgatcttggagatgatgatttgtcataattctatcttggtggcagagttagtatgaggtactaagggcttttatttaagctgtgtgccatctcacttatttgtgtttttc

SEQ ID NO: 80905 - DNA, 408 bp, Homo sapiens
ctcgaccctcagcctcctgtgcagctgggattacaggcatgcaccaccacactttgctaatttttgtatttttagtagagatggggtttcaccatcttggccaggatggtcttgaactcctgacctcgtgatccacctgcctcggcctccctaagtgctgggattacaggcatgagtcactgcacccagcccactacttggctttccgttttctttttttcttttttttttgagtgttgtcagaactaccaataggtaaaatataattctcaggtagtctatacaattctccctgccagtcccctgtacttttcctggtatttacaatgttaaagcttttaaggacacgtcacctataactctgggagtctggctttcagggagtgctttgtattaactgtgtcgacg

SEQ ID NO: 80906 - DNA, 331 bp, Homo sapiens
gaaacatttcaagaaagcatactaaatgacagaaattctacttaatattttataacatgttcaactaatgataaataattttgtgaactctggaaacagaaaaggaacaatgtcatggaagagaaaaatttctgcaataggaaaactcttcattagtgaaaatgataccaataaaagaacaaaaattagcggggggtggtgatgcatgcctgtaatcccagctactggggaggctaagacaggagaatcactcgaaccggggaggtgaaggtggcagtgagccaagatcatgccactgcactccagccggggtgacagtgcaagactcctc

SEQ ID NO: 80907 - DNA, 397 bp, Homo sapiens
accctgttgtattgcccctcttccctgctgtttctcccttcccagggcacagattctagaatctcttcatcttccccaactgtagccttggaagcagtgtcttgcagaggtggaattagatgcaccaaaaagttaatcttggtccctacagtgccaacctggcagtccccagtgcttatggctttgtgtatatccccagtgcccggcacagtgcctggcacataatagatgctcaataaatggttgctgaattgaagcaaattaagctgaatctcccagatgatattgctgtctccccaaattggcaatctgatgggcagaggcagggattggtccctgagactgtcacggtcctgtctccaccccctttcctagacttattccctaccctgggcac

SEQ ID NO: 80908 - DNA, 271 bp, Homo sapiens
agtctaggggcaaaattttgatgaagatcagaatattttcaaagtctactcaccaattatgtactacttgcaagggaaaaacatagtaaatgtaccacagcaaaaaatgacaatacgtgaattgagtgatcaaaattaatatcaacaatgaggggcaggtagacatcatgtacttaggaatgcaagaccccaaaagactcactgtcacctatatagcattccagatttggaatttataatctaaagaaacattagaccaatcctaaacaag

SEQ ID NO: 80909 - DNA, 562 bp, Homo sapiens
ggaggctgaggtgggaggattacttgagcctaggaatctgaggctgcagtgagccacagagaccccatctctaaaacaaacaacaaaactacacacacagaggcaaacagaagaaagcatgtaagaaagcacagatagtatgtgcagagattacatgtagtctagttttactgcaggacctagagagattgagagagaggtagatgatgccaagaaagatggaactgagaacctattccaattgtccagaagataacagcctgaagtaaaatccttccttctaaattgcatgtgccatttagaattatctaaaggaagagagagaaaaaaagcaaagcctgccttgtcttccaggctgaaggagcccagggaattctaccacaaaatatggctccctggtataagtattttgaattaaagccccatcagagatcaacagatgctagaagagactttttccctatctacaaaaagaccagacagattccccaaggggaacaattgttttcccttctcctcctcagggagaagggaaaacaattttattatttgctgcagaaaa

SEQ ID NO: 80910 - DNA, 395 bp, Homo sapiens
aggccaagaatgaagaaagacaggaaaccagaagaataatcaaatgctaaagttgcagctgccctgaagttgttctctaaaatagaaacatgaaaccacttggggatcaggaaacaaggccttcggcctgaagaaggtagggaataggaattgagattctccacacagagtggggaccctcaaagcacattagtgggcttcagtaatgtaattcagccccagtaatggactcagaaataactgcttccaacaaagaaagaccacaagaacaattgttggtgccagccttcactatggatggggatgtaaaagtctgatatgagaatttctacgtattcaggcttaaatttacacagtttgcatgctcttggaaaccaacagcaagaacttggagt

SEQ ID NO: 80911 - DNA, 434 bp, Homo sapiens
tagcagcagcaggaatagagataagggaatggatttttaaaatcttgagaagttagagatgaagcctggtgactaactggatatgggagatgatggagcaagagtgggagatgagcaggtttctactggatgggacagaaagcaaaaaggacaggactcagcaagaacaagtcatggcaagtgtcagaaagaccatgtagacagcatttaacttggcagatagcccactgggacctctcatttgggccaacagaaaggtgacaggaaagcggagaaatttctgtggtgatgtatgggtatctctgcagatgtcagcagaggcaggctcctctgggagaagaggaggaatctggggaattaacgcgtattctccacaaaaggagaattagtggaggctgggcaaccagagtcagcccaattaacctcactgtcct

SEQ ID NO: 80912 - DNA, 1534 bp, Homo sapiens
  misc_feature (247)..(247): n is a, c, g, or t
  misc_feature (1028)..(1029): n is a, c, g, or t
ccacgagctgcccacgtcctctccaggaggggacaccgggttcacgagctgcccacgccctctccaggaggggacaccgggttcacgagctgcccacgtcctctccaggaggggacaccgggttcatgagctgcccacgccctttccaggaagggaccccgggttcacgagctgcccacgtcctctccaggaagggaccccgggttcacgagctgcccacgtcctctccaggaagggaccccgggtncacgagctgcccacgtcctctccaggaagggacccgggtcacgaactgcccacgtcctctccaggaagggaccccgggttcacgagctgcccacgtcctctccaggaggggacaccgggttcacgagctgcccacgccctctccaggaagggaccccgggttcatgagctgcccacgtcctctccaggaagggacccgggtcacgaactgcccacgccctctccaggaggggacccgggtcacgagctgcccacgtcgtctccaggaagggacccgggtcacgagctgcccacgtcctctccaggaagggacccgggtcacgaactgcccacgcgctctccaggaggggacaccgggttcacgagctgcccacgccctctccaggaagggaccccgggttcacgagctgcccacgtcctctccaggaggggacaccgggttcacgagctgcccacgtcctctccaggaggggacaccgggttcacgagctgcccacgccctctccaggaggggacaccgggttcacgagctgcccacgtcctctccaggaagggacccgggtcacgagctgcccacgtcctctccaggaggggacaccgggttcacgagctgcccacgcactttccaggaagggaccccgggttcaggtctcctgccggcccacatcgtgcctttgtgtaaatcagaagaaagatgaggaacaggccctcctctctctccaggcaggctttggtggaggggctggatctcctgccgcaccttccctggcaggcaccctgtnnttgagccccagaactgcaggcggccggcagagaaggggtccatgatggcgcctcggtgcggccttggacctgcccccatggacctggagacagggtttctcctcattggccaggctggtctcgaactcctgacctcagacgatccacctgcctcagcctcccgaagtgttgggattacaggcacgagccactgtgcccggccatcattcctttttactgctgactaatagtctgctgtgtgaatccaccgctagaaacccactcatcagttgatggtcatgtgggttgcttctgctattcgcttattatgaacagtgctggaataaacgttcctgtgcactcttgggcatacgcctaggagtggaactgctgggtcaaatggtgactttacgtttaacgttctgaggagccgccaggcgttttaacacagtgactgcaccatttcacattcctgccaacaatgtgtgagaattccaatttctctacatccccaacattttccttt

SEQ ID NO: 80913 - DNA, 442 bp, Homo sapiens
tttttttttttgtatttttaatagagacagggtttctcctcattggccaggctggtctcgaactcctgacctcagacgatccacctgcctcagcctcccgaagtgttgggattacaggcacgagccactgtgcccggccatcattcctttttactgctgactaatagtctgctgtgtgaatccaccgctagaaacccactcatcagttgatggtcatgtgggttgcttctgctattcgcttattatgaacagtgctggaataaacgttcctgtgcactcttgggcatacgcctaggagtggaactgctgggtcaaatggtgactttacgtttaacgttctgaggagccgccaggcgttttaacacagtgactgcaccatttcacattcctgccaacaatgtgtgagaattccaatttctctacatccccaacattttccttt

SEQ ID NO: 80914 - DNA, 374 bp, Homo sapiens
cacttactttcactctattgcaaggtgcacagttctagataattccgtgggaaggcactcagacagcctccatatgttttgtttgttggtgcctgacggatgactggcggagagggccatggactctgcggggaggccgcttgcctgttgtctctgctttccaggtggagatctgcattccaggctcttgctgtatgactttgggccagtttgttaacctctctgagcctcagcttctgaatctgtatgtaaactggagatgataattatagcttcttcataaagttgtgaggaatgaaaatactgtataaaagcactgacacctaagtgttaaatattcttataagtcataagttgtaatattctcttttcat

SEQ ID NO: 80915 - DNA, 520 bp, Homo sapiens
tgcggagatggggtctcactgtgttgcctaggctggtctcaaactcctaggctcagctgatcctcccaaagtgctgggattacaggtgtgtgccatatagtcttagccatccttccatttcagctgatgtaaatctacttcattctttttaacagatgcagagttttccatatgtggaggtactgtagtttattcttaagacccaactgatgaacattaaaggtgtcttcagttgattatgaaaaggttttttaatgaacattgttgtattttaaccatatattatatatttgatccttgtgcacttgtacaagcatttcttcatgatggattcctagagaagggcctgctgaggcagtgagtttatacatattaaactatggtatgttgcatattatttctttcagcagtgtgcctcagtttacacacccgtaagcagtagagataaggatgtcatttttctgtcaccacttgatagtgtcagtattttaaaacaaatgcaagtgttagaaattacaaa

SEQ ID NO: 80916 - DNA, 696 bp, Homo sapiens
tctgttttctataccttacttccattttcagtgactcacttctgttttttataccttatttccatcttctgtatcttacttttcactacctcacttctgtttttcctatctcacttccatttcctgtgacttatttctgttttctctacctcacttcctgttattagacctcacttctgtttttttacctcattttcatcttctgtacatcacttgtttttcatgactctcttcggtttcctgtgacttctgttttctgtacctcacttctgtttccctaacatcattagcatcttctgtacctcacttctatttttcataactgacttccgttttctgtgacttacttccgttttctctacctcacttccgtttgctgtacctcacttctgttttctgtaacttccgttttcactacctcaattccgttttttataccttatttttgtcttctgtatcttattttttcactacctcacttccggttttcatgactcacttccgtttgtttacttcacttccgttttccgtacctctcttctgttttcctaacatcatttgcatcttctgtacctcacttctgtttttcataactcacttccgttttctgtgacttacttccgttttttctacctcacttccgtttttctacctcacttctgttttatgtaccttacttccgttttcactacttta

SEQ ID NO: 80917 - DNA, 437 bp, Homo sapiens
  misc_feature (332)..(332): n is a, c, g, or t
  misc_feature (368)..(368): n is a, c, g, or t
  misc_feature (392)..(392): n is a, c, g, or t
  misc_feature (428)..(428): n is a, c, g, or t
acaaattagtggtgctgtaaccagttaataattcagcttaatccttctgtcatgaaggtttcatattgttttaatcttagtcatgtattttattaactcttactcattgtttcaatacttcattcaatagatcaacggttagagacaagaagcattaagaaaattaagtcgataatgaaatactagatgatgagcataaaaatgtaaatgattctaaatatttggttcacgatttttgttacttttttctttttttttgagacagagttttactctgtcgccaggttggagtgcagtggcgatagagggagtactctgtctttaaaaaaganaaaagtgaacaaagtgaacacctgtgaccaaatttngaacacaaggtttatggacccttnacacttaggactgggtattggctaattcgggaggcntgaggttgg

SEQ ID NO: 80918 - DNA, 606 bp, Homo sapiens
ctgctccacgcaatttctcagtgatcctctgcatctctgcctacaagggcctccctgacacccaagttcatattgctcagaaacagtgaacttgagtttttcgttttatcttgatctctctctgacaaagaaatccagatgatgcgagacctgatgaagacaatacatggaaaatgacagtcttggaaataactttggctgtcatcctgactctactgggacttgccatcctggctattttgttaacaagatgggcacgacgtaagcaaagtgaaatgcatatctccagatacagttcagaacaaagtgctagacttctggactatgaggatggtagaggatcccgacatgcatattcaacacaaagtgacacttcatgtgataaccgagagagatccaaaagagattacacaccatcaaccaactctctagtgtctatggcatctaagttctccctgggacaaacagaactcattcttcttttgatgtgttttattttagcactgtctcgatcaagtattggtagtataaaatgtttacaaacaactgaagaacttccttccagaactgcaggagccatgatgcaattcacagcccctattcccg

SEQ ID NO: 80919 - DNA, 614 bp, Homo sapiens
tgtggagacgggggtctcactggtgtggcccaggccgggagcgcaggggctggtttataggctctgtcacagtcactggcacgctccagctccggggcagtcctccggcctcagcttcctgcgtaggtgggactccgggcccatgccactgcacccagcttatgatgctggttttggaaatgggggtggctattcccagggttgagtgtctgtgggggagttggggcatggtagtgggagttataaattcaactgaggtctttattttcattaagtggatcctcattcctaagcaaataactgacgtgctcttgttggatagaagatggtatgggaagacagggtgaggattggtttgcattttgagttgagtatttttttattattattaagtcaggtttattgagatataatttgtttactcttcatcatgataaattttccccaattccagaagaaattaaatggagttacattcacagtacaaaattgagatattatactaaagtaagaagctaaaggaagacctctttagttgtaccagtctgtaaattgtggcaaacacaagtcttgtgaattaccaccacactcaagacagagaaccatttcctcac

SEQ ID NO: 80920 - DNA, 687 bp, Homo sapiens
tgcaagatcaagttgggataaagtaatgcttgtggctttaaggatgaaagcttgcgtgccagtgtagaaaccatattcccagactatagtgaggaatactgagcctgctagggtaagctttcttttatttagtgggccctagaaatgtccagcttctagaaaggtagctatttaaggaatgatatttcaacaggaaagtctttaaatgcatacatcaatacagaattctgggatcatgccagtcagtagatataaatccagccatactggttggaagtggcaaatggtatatgcatgagctgaaatatttctgtttcttcttggacattttaggttctcaactataaagacattttataactatttaaaacattaggatttcagccatactaatattttattttacaaaactagttttattttacaaaactagtagtgatttccagataacagtctgaattttttactgaagaattcagtgtctgagtattgtggaagctaccaaaataataataataataataattaaaggccaggtatggaggctcatgcctgtaatcccagcactttgggaggctgaggcaggaggatcccttgaaatcagttcaagactagcctgagcaacaaagcagaacccatctctacaaaaacaagcaataaactatatctacttatatgtataaacta

SEQ ID NO: 80921 - DNA, 363 bp, Homo sapiens
atcatggtcttgattgctattatcggtttccatacgcagttagaaacgtcatttcttccagcttttgaattaaagaaaagctgtttttgaagttgagatctgatgtaaattattttagtatttttttctaagacacttctaagcccctgaattgctaattatatcctcatcttccatttacaaaattccttctaaacttcagataagagaactcaaatcttctcttttctaaaaaaaaaaactatcaatgtaaaaatagtatagaaattatggaaaataattcagtgaaactttttgtaaatgttaaaatagtatctatgaaatctatgtattaattatgggatgtgccttaccattgtaatt

SEQ ID NO: 80922 - DNA, 231 bp, Homo sapiens
cctgtaatcccagcactttgggaggccgaggtgggtggatcacctgagcctcccaaattgtgggattacaggcatgagccactgtgctcagcttattatttctttactgctgaagaataatttcaaacatttgcaaagcaaaagcacagagcaagtcttgcccgtcaataaagtttaaccttacagagaaatgaaaggggaactttttgcatgttatacattaaaatggga

SEQ ID NO: 80923 - DNA, 298 bp, Homo sapiens
gtgctttacacaatttttatcatttaatcctcattataaattctaccaataaaatactgccgttaatttcattttgcagatgggaaaactgtggtacagaaaagaaataaaactcacgtaaagtttcccatgatgcctctatttccttcgtacctaggatcctttctcatctgtggcacattctacaccagagttagtggaaaaatccatctgtataactcaaataactcaacagttaacactcaagtgatttctgctatggccttgactgatagttgtacaggatggtatagaaagt

SEQ ID NO: 80924 - DNA, 397 bp, Homo sapiens
ttactgtccccaaagcagccagcataacctcttcatttagagcatggcactcccctgctcaagatctccccaagagcttcccatcaaactggagtaaaaccttaacttcttcctacagcctacaagccaaaaggccctgtgagctatggtactgcctgaagggcctcatctccactctttccctcattcttcactctgactatgctggtcaccttgctgtttgttcctcaaacacacatgaaatgcatttctgtctgtcttggcagtcatcctgctgcctgtaatgtcagcactctttcccgtcgcgccttcagtcaggtcactgttctaatgtcagctctctagagaggctcttccttatctgtctacctaaaatagcccccaatcactctgtatc

SEQ ID NO: 80925 - DNA, 4995 bp, Homo sapiens
  misc_feature (1)..(1): n is a, c, g, or t
  misc_feature (585)..(585): n is a, c, g, or t
  misc_feature (713)..(713): n is a, c, g, or t
  misc_feature (851)..(851): n is a, c, g, or t
  misc_feature (993)..(993): n is a, c, g, or t
  misc_feature (2066)..(2066): n is a, c, g, or t
  misc_feature (2174)..(2174): n is a, c, g, or t
  misc_feature (3290)..(3290): n is a, c, g, or t
  misc_feature (3513)..(3513): n is a, c, g, or t
  misc_feature (3644)..(3644): n is a, c, g, or t
  misc_feature (3652)..(3652): n is a, c, g, or t
ngtctgtaatgacaattttacatgtctaaatcaggaacaagcctaagtcatacttaagtcattgtacctaggaaagtacaatgtcagcttctaaaataaatcaagatttttctaggctgtaactttgttgacaacaggaatcacatctgttttatatatcactgtattaccatagtcacttatttggtgactgagtcataaaagattcaaagatggcaattataactttaaagcaaacttttaaactattttgtcatttttaaaggcaatttgaaatcagatcttgtaacagtgctgcaattgggcccataatttgggcaatagatgtaaaataaaagtatgaggaatgatgcttaatctctgtaattatttttaagaacctactaagagatgaattttagtcattttagcataactggtgagacctcttgctagataataatttgctggcctttattttacataattaagattctgcatgtaatcttacagcattaagatataatctaaaacttttattttagacagaatgaaaacaggcctagatgcaccaaaagagcctcaaaacaatataacttggatgantcattatgcgacgtgggagtgattatggcttagaaaggtttataccttttttttttttttgacacagagttttactcttgttgcccaggctggagcaagactcgatctcaaaaaaaaaaaaaaaaagntttctgttattcttttttcaaaatcttggaatatggaaaggctttctaaataagacacaaaacccagaagccataagaggaaattctgagaagtctgaatatgtaaaagtaaaaaatttataaggcagaaaaattttnttgactaactaaaaggtagtaacaaagtagaaagaataggcattttacagaaataggcaagttcataaggtgagaaatacaaatggctggaaaaagaacacatgaaaagatgttcaacctcaatcgtatttaaatatgcaanttaagctcccaagaaaaagatgaaaatttaaataacctaaagcaacaatatatttttacctattaaactgactagataatacttttttcaaccacctacaaaatatgatgagtggggaaaggaaggaggaaagaatattcttataaatgttaccaaaaatgttacccatttgtaagtatgggagcataaactggtaaaatctctttagagagagcctcaaaattgaaattggcaacatttattggcagtcattagtgtccttccccacattcttctggctctctgtctcccaggtatgtggtagaactgtgcctccctgttcctgctgaattaggtgtggctgtgtgctttgttttagctacagagtaacatgcgttgaggcagaggcttaaggagccactgctcacccactatgtttccttggtcatggaagcacagagatggagcttcccttaacctgggtcccttggtgagggtgatggagaacagaggccaccagctaatctatatgggacaggaaatgtgagctagaaataaatcttagttgtttttaagacatggtttgttactgcaacataaccaagcctaaatgatacatctatcaaaattaaaaacacatatatccttggacacagcagtttcactcctagtaatctcacagtctgccaagatacttggacatgggtacaattatgtgtacacaaggatttttattgcagcactgttcataaaaacaagattagcaactacttaaggtctatcaagaatggactggttagatattatggtacacaatactatgcagccatttcttaaaaagcagatcctgctgacatggaattctctcaaagagataaagacaaaaaaaagagacataatcctagaagaatacaaaatgaactgtttgagaaactagttatctctagtgaggggaatttttcattatataccctttagttctgttttcagttttttaaaaaagcaagtatgtaggaaaatattttaatgcaattcctatcagaattccagttgacttctatgtagaaattgacaaactgattctaaaatttacntagaatttcaagagactctaaatagccaagcctatcttgaaaaagaaccaagcaggagaactcacatgtcccaatttaataataaaataattacagtaattaagaccntatggtattggcataaagaacatatagaacaatggaaaagaattgagagtccagaaatgaacccacgcatttatggtcaactggttttttacaggggtgccaaaatcactcaatgaggagaaaaagtcttttcaacaaatggtgctgggatacttggatagccacatgcaaaagaatgaagttggattcttacttcatgccatgatatagaaattgcatcagaatggatgaaagatcaaagactagaatataagaactaatattatataactcttaggaggaaaaaataggggtaaatctttatgacctcacctcagagttagaaactgtttcttaggacaccaaacgcaagagcaataaaagaaaaaatacatagagtttggacttcagccaaataaaaaacttgtgcttaaaggacaccatcaagaaagtgaaagacaatacacagaatgggagaaaattgcaaatcatggaagggacttatttctagaatatacagagaactcatacaacttaacaataaagatgaataacctaatttaaaagtaggcaaaggatatgaataggcatttctccaaagaaaatatgcaaatggccagtaagcacatgaaatgatgcttgacatcattagccaatagggaaatgcaaatcaaaatcacaattaaatactttgcagccactaggatggcaagtaacacaaagtcagataaaagcgttgttgaaaatggggagaaatgaaaaccctcacacacagctggtgagaatacaaatcactttggaaaacagtatggcaacaattccactgctgaaaaggtggaaaaaaacaaaatgtctattaactgatgaatgaataaatgaaatgcagtgtatttatataatggcatatttggccataaaaaggaaagaacatgttgctgctataccatagatgagtcatgaaagatcagattccattttatatcacgtgtccagaatatgtaaatttatcgagaaagaaagtagattagtggttgcctagtgctgagtgagggtgggggtaatgggatagggaggtgatagcttacaggatatgaggtttcctgtagaggagatgaaagtgttctactggctgggtgntggctgcacatatcagtgaataaactaaaaactgatgtatactataagtcaactgcatgtatattaactatatctcaataaagctgttaaaataatgactaaacattaaaaaattttaaagaataatagatttacgtaacttaatatatttaagaaagtgtactgttctcatttagtgaatgtcagacatattgtagagtatgtgcatattatataatcccgngtgttcacagacccatgtgtatagtgtgttcctgctttaagaacagtgtgtgtatacacatatatacacacacgtatgtgtatgtgaatataaagggaatgaatataatgggaaggggaatataatggganggggattnagtgaatctaatgggaaggggataagtaactgctaatagagaatacctctcacagttaaataagggaaaagctggaggaagtgacaagtcaaaggttgaaaagaaacacatttttattgcatttgttttttaaaatttcttttactgagtgtgttattttcataatactttttaaaggtattaatttaatgtaagaaataaccagctagtaggtagagctctccaaaaccagaatatgctaccttaggaggcagtttgtgtctcataagaatttaaagtacagaaaggatttacacttgataggctggatgggtacgtggactggataacctttggagtagaattcttcatgccctttaaagtctcttccaattctgacatttaccccaaattaaaaaggtatttagtcttaagactgggaggaacctacaagtagtagggctaatttgaaaaaaatattctgtaagtggtccaatgtcaactaatcttaattgctgagtttattattgttattttagagacaaagtcttgctacattgccctggctggtcttgaactcctgcactcaagcagtcttcctgcctcagactcccgagtagctcgaactacaggcatgtgctactgcagtaggcttttatttaataaagtgatttcaatgtcaacaaagaataacaaaaaggtatttccaatgaaaagatacataaagttaaacaaagtacaagttttagaatctgaactaaataaaattatatttccttttgaagagtatcttgctcattgaatttgtgccacaataaacattttttattaaatctcattaaaaagaaacgtgttgtgatttggatagatgtactagtgaaaaatggtaaggagtgggaaacacaaagtccaagaagctaattttcaactcataatttttcttacttgtatttctattttaggttcaaagtcaaggctactgcttaacactatggtaggactttaaacataactgaggaaaaaccatattaaagtatcattaaaaatatttatcattttatatatgtaattttttttctttaaataataaaaagtttaccagctaagtcaataccacagatggagttgtgtggaaattgtatttggcagcaatgttagttttttttaagagtttctggcttctgtaacaaaataagaaagtaggcctttttctctccaccatgaaaatttgttggaatgctttgtcctccatacctataaaagttgccagtgttacaacaggcataccacccaactctagcttccaaaaaatgttgaaactatcattcagcatattctgagacattctagtgtcttacgggata

SEQ ID NO: 80926 - DNA, 223 bp, Homo sapiens
tagagacagggtttcaacatgttggccagcccagtctccaactcctgaccttaagtgagcccatacacaatcaagaagagagcgagacctgttctttttttctgtctttgactatttgagacagtcttgctctgtcacccgagatggagtacattagtgtgatcttggctcactgcaacctctgcctcctggactcaagcaattctcttttttttttttttgg

SEQ ID NO: 80927 - DNA, 871 bp, Homo sapiens
ggattacaggcgtgagccaccgtgctcggccagtagtaaacttttaatgtcatttcccacttctctggctgcccctctcttcttcttctgatagaactgttcactgagatcctctggtcttccttccgtcctcatactcgccatggcttcagcattaaagtcataggctttggcgtcaaacccgactgggttctagttctcctacctacattttggtgactcttaaccccaaattgctaatttctgaaagtgtttttgagctgtagtttcacatttgtaactgcttccttggcaggcatgttcatatccctgactagttagttcctcagatccagctttctaaaatcactcagcatctttaccctcctctttctggattttcaaagtctgctaatgtagcctccgtttttctcagaactagggagtcattgacatctttccctcctttgcccttcctaattcatttagtggccagcacttttcaatgttatcctcaaaagagcttgagaagctactccttggtctctaccccaactgccactatccccctgaattattcttggagtcttcttgtgtaacaaacccgtttttcagattctcatctcatctattacacaccatccccttagcttttgtagagcttttattttgaagtaattttagactttcaaagatactgcaaaaatagtgcagagacccaacacaaagaaatgatacacgtttgaggtgatgggtatgctaattaccctaatttgatcattacacattgcatacatgtatcaaaatatcacactgtaccccataaatatgtacaattattgtgtcaatttaaaataataaaagtaaataaaataattctcttgtaggcaaa

SEQ ID NO: 80928 - DNA, 4242 bp, Homo sapiens
  misc_feature (212)..(212): n is a, c, g, or t
gggccgagccgcaggcgctgcccgagccgcgggcgctggagcggctgtcggcgcggtggcaggcgggagccaggagtccggggctcgggcgggcggagcgcagcgcggggacgcggcggagcgggccccgcggctcggcgggggccggcagacaggtgtgccggcggcgggcggctcgcacgcaggcggctccaggcctccaccggcggtcnggaggggaggcgggaggcgagcgaggacccgcgcccgcagtccagtctgtgcgcgcccgtgctcgcttggcgcggtgcgggaccagcgccggccacccgaagcctagtgcgtcgccgggtgggtgggcccgcccggcgccatgggctcaggatgccggtgcggaggggccacgtcgcgccgcagaacaccttcctggacaccatcatccgcaagtttgagggccagagccgtaagttcatcatcgccaacgctcgggtggagaactgcgccgtcatctactgcaacgacggcttctgcgagctgtgcggctactcgcgggccgaggtgatgcagcgaccctgcacctgcgacttcctgcacgggccgcgcacgcagcgccgcgctgccgcgcagatcgcgcaggcactgctgggcgccgaggagcgcaaagtggaaatcgccttctaccggaaagatgggagctgcttcctatgtctggtggatgtggtgcccgtgaagaacgaggatggggctgtcatcatgttcatcctcaatttcgaggtggtgatggagaaggacatggtggggtccccggctcatgacaccaaccaccggggcccccccaccagctggctggccccaggccgcgccaagaccttccgcctgaagctgcccgcgctgctggcgctgacggcccgggagtcgtcggtgcggtcgggcggcgcgggcggcgcgggcgccccgggggccgtggtggtggacgtggacctgacgcccgcggcacccagcagcgagtcgctggccctggacgaagtgacagccatggacaaccacgtggcagggctcgggcccgcggaggagcggcgtgcgctggtgggtcccggctctccgccccgcagcgcgcccggccagctcccatcgccccgggcgcacagcctcaaccccgacgcctcgggctccagctgcagcctggcccggacgcgctcccgagaaagctgcgccagcgtgcgccgcgcctcgtcggccgacgacatcgaggccatgcgcgccggggtgctgcccccgccaccgcgccacgccagcaccggggccatgcacccactgcgcagcggcttgctcaactccacctcggactccgacctcgtgcgctaccgcaccattagcaagattccccaaatcaccctcaactttgtggacctcaagggcgaccccttcttggcttcgcccaccagtgaccgtgagatcatagcacctaagataaaggagcgaacccacaatgtcactgagaaggtcacccaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtacgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctggggaagaatgacatctttggggagcctctgaacctgtatgcaaggcctggcaagtcgaacggggatgtgcgggccctcacctactgtgacctacacaagatccatcgggacgacctgctggaggtgctggacatgtaccctgagttctccgaccacttctggtccagcctggagatcaccttcaacctgcgagataccaacatgatcccgggctcccccggcagtacggagttagagggtggcttcagtcggcaacgcaagcgcaagttgtccttccgcaggcgcacggacaaggacacggagcagccaggggaggtgtcggccttggggccgggccgggcgggggcagggccgagtagccggggccggccgggggggccgtggggggagagcccgtccagtggcccctccagccctgagagcagtgaggatgagggcccaggccgcagctccagccccctccgcctggtgcccttctccagccccaggccccccggagagccgccgggtggggagcccctgatggaggactgcgagaagagcagcgacacttgcaaccccctgtcaggcgccttctcaggagtgtccaacattttcagcttctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggctggagacccggctgagtgcagacatggccactgtcctgcagctgctacagaggcagatgacgctggtcccgcccgcctacagtgctgtgaccaccccggggcctggccccacttccacatccccgctgttgcccgtcagccccctccccaccctcaccttggactcgctttctcaggtttcccagttcatggcgtgtgaggagctgcccccgggggccccagagcttccccaagaaggccccacacgacgcctctccctaccgggccagctgggggccctcacctcccagcccctgcacagacacggctcggacccgggcagttagtggggctgcccagtgtggacacgtggctcacccagggatcaaggcgctgctgggccgctccccttggaggccctgctcaggaggccctgaccgtggaaggggagaggaactcgaaagcacagctcctcccccagcccttgggaccatcttctcctgcagtcccctgggccccagtgagaggggcaggggcagggccggcagtaggtggggcctgtggtccccccactgccctgagggcattagctggtctaactgcccggaggcacccggccctgggccttaggcacctcaaggacttttctgctatttactgctcttattgttaaggataataattaaggatcatatgaataattaatgaagatgctgatgactatgaataataaataattatcctga

SEQ ID NO: 80929 - DNA, 3511 bp, Homo sapiens
  misc_feature (212)..(212): n is a, c, g, or t
  misc_feature (3504)..(3510): n is a, c, g, or t
gggccgagccgcaggcgctgcccgagccgcgggcgctggagcggctgtcggcgcggtggcaggcgggagccaggagtccggggctcgggcgggcggagcgcagcgcggggacgcggcggagcgggccccgcggctcggcgggggccggcagacaggtgtgccggcggcgggcggctcgcacgcaggcggctccaggcctccaccggcggtcnggaggggaggcgggaggcgagcgaggacccgcgcccgcagtccagtctgtgcgcgcccgtgctcgcttggcgcggtgcgggaccagcgccggccacccgaagcctagtgcgtcgccgggtgggtgggcccgcccggcgccatgggctcaggatgccggtgcggaggggccacgtcgcgccgcagaacaccttcctggacaccatcatccgcaagtttgagggccagagccgtaagttcatcatcgccaacgctcgggtggagaactgcgccgtcatctactgcaacgacggcttctgcgagctgtgcggctactcgcgggccgaggtgatgcagcgaccctgcacctgcgacttcctgcacgggccgcgcacgcagcgccgcgctgccgcgcagatcgcgcaggcactgctgggcgccgaggagcgcaaagtggaaatcgccttctaccggaaagatgggagctgcttcctatgtctggtggatgtggtgcccgtgaagaacgaggatggggctgtcatcatgttcatcctcaatttcgaggtggtgatggagaaggacatggtggggtccccggctcatgacaccaaccaccggggcccccccaccagctggctggccccaggccgcgccaagaccttccgcctgaagctgcccgcgctgctggcgctgacggcccgggagtcgtcggtgcggtcgggcggcgcgggcggcgcgggcgccccgggggccgtggtggtggacgtggacctgacgcccgcggcacccagcagcgagtcgctggccctggacgaagtgacagccatggacaaccacgtggcagggctcgggcccgcggaggagcggcgtgcgctggtgggtcccggctctccgccccgcagcgcgcccggccagctcccatcgccccgggcgcacagcctcaaccccgacgcctcgggctccagctgcagcctggcccggacgcgctcccgagaaagctgcgccagcgtgcgccgcgcctcgtcggccgacgacatcgaggccatgcgcgccggggtgctgcccccgccaccgcgccacgccagcaccggggccatgcacccactgcgcagcggcttgctcaactccacctcggactccgacctcgtgcgctaccgcaccattagcaagattccccaaatcaccctcaactttgtggacctcaagggcgaccccttcttggcttcgcccaccagtgaccgtgagatcatagcacctaagataaaggagcgaacccacaatgtcactgagaaggtcacccaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtacgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctgggtatggggtggggggcgggcactggactggaaatgccctctgcagcctcaagaggtgcgagccttctgaatatgcagtcactggggctgtggacctgggactgcctgcagggtcactgggctcctttaattcacctaaactcaggccctccaagcggggccatggagaggagccccacgtggggtgaggctgctgaactctggggttcccacattctccttcccttcaggatccgccacaaacagacactttttgcttccttaaagtaggatcaaatctagatcctctagcctgggcagtagaggaagaaatgctagcctggaagctcggcatttggtttcactaagggccatgtggttccctgcagcctcatgcctggccccttgacacatccaaagcaaagggagtcctgccccctccccccacttcctttctaccctgcctgtgcacagtgggtgggttggtgtgtctggacactgaggacttcctccccctttgcctgtccttccctcggccctgtgtgcctcagggcagatatagcaagctctttcgaccatagttgatggtaggacattttagactttgtttctcagctctgtacaaacacaaatacacacccccacaaaactaaaatcaaagtttcactacataacactgggccttactgcatgtggttcattctagcatttctgttctgtgctgtgctaagctatactactgtatgttctttcagtaaaaaaaannnnnnna

SEQ ID NO: 80930 - DNA, 426 bp, Homo sapiens
gtgcccagaggtggggaattgggtggagcccctgacctcggatgggttgggatgctgggcaggaacagtgccccccaccccaggtagactgctgggtgtggattggcaccaaatgaaagcaagccggcgttgtgttctgagaagtgatggacaccttctgtggtagcaggatggcgctgtacctgccactctgggccccagtgagaggggcaggggcagggccggcagtaggtggggcctgtggtccccccactgccctgagggcattagctggtctaactgcccggaggcacccggccctgggccttaggcacctcaaggacttttctgctatttactgctcttattgttaaggataataattaaggatcatatgaataattaatgaagatgctgatgactatgaataataaataattatcctga

SEQ ID NO: 80931 - DNA, 3340 bp, Homo sapiens
  misc_feature (212)..(212): n is a, c, g, or t
  misc_feature (3333)..(3339): n is a, c, g, or t
gggccgagccgcaggcgctgcccgagccgcgggcgctggagcggctgtcggcgcggtggcaggcgggagccaggagtccggggctcgggcgggcggagcgcagcgcggggacgcggcggagcgggccccgcggctcggcgggggccggcagacaggtgtgccggcggcgggcggctcgcacgcaggcggctccaggcctccaccggcggtcnggaggggaggcgggaggcgagcgaggacccgcgcccgcagtccagtctgtgcgcgcccgtgctcgcttggcgcggtgcgggaccagcgccggccacccgaagcctagtgcgtcgccgggtgggtgggcccgcccggcgccatgggctcaggatgccggtgcggaggggccacgtcgcgccgcagaacaccttcctggacaccatcatccgcaagtttgagggccagagccgtaagttcatcatcgccaacgctcgggtggagaactgcgccgtcatctactgcaacgacggcttctgcgagctgtgcggctactcgcgggccgaggtgatgcagcgaccctgcacctgcgacttcctgcacgggccgcgcacgcagcgccgcgctgccgcgcagatcgcgcaggcactgctgggcgccgaggagcgcaaagtggaaatcgccttctaccggaaagatgggagctgcttcctatgtctggtggatgtggtgcccgtgaagaacgaggatggggctgtcatcatgttcatcctcaatttcgaggtggtgatggagaaggacatggtggtggacgtggacctgacgcccgcggcacccagcagcgagtcgctggccctggacgaagtgacagccatggacaaccacgtggcagggctcgggcccgcggaggagcggcgtgcgctggtgggtcccggctctccgccccgcagcgcgcccggccagctcccatcgccccgggcgcacagcctcaaccccgacgcctcgggctccagctgcagcctggcccggacgcgctcccgagaaagctgcgccagcgtgcgccgcgcctcgtcggccgacgacatcgaggccatgcgcgccggggtgctgcccccgccaccgcgccacgccagcaccggggccatgcacccactgcgcagcggcttgctcaactccacctcggactccgacctcgtgcgctaccgcaccattagcaagattccccaaatcaccctcaactttgtggacctcaagggcgaccccttcttggcttcgcccaccagtgaccgtgagatcatagcacctaagataaaggagcgaacccacaatgtcactgagaaggtcacccaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtacgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctgggtatggggtggggggcgggcactggactggaaatgccctctgcagcctcaagaggtgcgagccttctgaatatgcagtcactggggctgtggacctgggactgcctgcagggtcactgggctcctttaattcacctaaactcaggccctccaagcggggccatggagaggagccccacgtggggtgaggctgctgaactctggggttcccacattctccttcccttcaggatccgccacaaacagacactttttgcttccttaaagtaggatcaaatctagatcctctagcctgggcagtagaggaagaaatgctagcctggaagctcggcatttggtttcactaagggccatgtggttccctgcagcctcatgcctggccccttgacacatccaaagcaaagggagtcctgccccctccccccacttcctttctaccctgcctgtgcacagtgggtgggttggtgtgtctggacactgaggacttcctccccctttgcctgtccttccctcggccctgtgtgcctcagggcagatatagcaagctctttcgaccatagttgatggtaggacattttagactttgtttctcagctctgtacaaacacaaatacacacccccacaaaactaaaatcaaagtttcactacataacactgggccttactgcatgtggttcattctagcatttctgttctgtgctgtgctaagctatactactgtatgttctttcagtaaaaaaaannnnnnna

SEQ ID NO: 80932 - DNA, 1603 bp, Homo sapiens
  misc_feature (1596)..(1602): n is a, c, g, or t
ggccggctggaggagctgaggttccgagtgcggccgctgctgggctggcgggcgggcagagcacggcaccctggcagcagggcccacgccacggggccatgggcagctcgagccaggcaggctgctgcccacgcttactgccagggtgaccccagccctggggcccagccacaaccaccctggcttcatgccaggggctgctctggttgccagtcggccagcctcgggggtgcagcctgggctgggactgctgctggggtgcaggtgaggcagtggccgggccctcaggccccagggcaggcaggctgcagggagccaagtcctccatggcggccccagccgggaaggcgagcaggacaggggctctgcggcccagggcccagaaaggccgggtgaggcgggccgtgcgcatctccagcctcgtggcccaggaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtacgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccctgtgctgtgctaagctatactactgtatgttctttcagtaaaaaaaannnnnnna

SEQ ID NO: 80933 - DNA, 2084 bp, Homo sapiens
  misc_feature (212)..(212): n is a, c, g, or t
gggccgagccgcaggcgctgcccgagccgcgggcgctggagcggctgtcggcgcggtggcaggcgggagccaggagtccggggctcgggcgggcggagcgcagcgcggggacgcggcggagcgggccccgcggctcggcgggggccggcagacaggtgtgccggcggcgggcggctcgcacgcaggcggctccaggcctccaccggcggtcnggaggggaggcgggaggcgagcgaggacccgcgcccgcagtccagtctgtgcgcgcccgtgctcgcttggcgcggtgcgggaccagcgccggccacccgaagcctagtgcgtcgccgggtgggtgggcccgcccggcgccatgggctcaggatgccggtgcggaggggccacgtcgcgccgcagaacaccttcctggacaccatcatccgcaagtttgagggccagagccgtaagttcatcatcgccaacgctcgggtggagaactgcgccgtcatctactgcaacgacggcttctgcgagctgtgcggctactcgcgggccgaggtgatgcagcgaccctgcacctgcgacttcctgcacgggccgcgcacgcagcgccgcgctgccgcgcagatcgcgcaggcactgctgggcgccgaggagcgcaaagtggaaatcgccttctaccggaaagatgggagctgcttcctatgtctggtggatgtggtgcccgtgaagaacgaggatggggctgtcatcatgttcatcctcaatttcgaggtggtgatggagaaggacatggtggtggacgtggacctgacagacccgacggaaaaccagacagagaagtcgacatggaccttgagacagaagctgacagaccaaatggacaaaacacagtggacagggacatacgaggacaccagcaagaaggaagcggacgaatagacaggcatggatgggggaataccaggggcaacatcacagaaaacacaaatatacatgacaggcacacagagacaaagacaaccacaaacgaaccacagagagacgacacaaagacatcaaaaccacaagaaagacacatagcgagaaatacaagacaggcaaacacatgaacaccacggggatcctgtacgacataacacagaggataaaagagttgacgaccagtacggatgaaagcacagaggaacgatagattcggagaacgaacataaaacatagaaagggacacatatgccgacgtaaacgtggagaatggcgttgtcacaaacagaacgaacaccgtgcggtcacacactgacacaaggaaaaccaggtgttgtacgcacgtttgacaagaccacgattatgtccattcaaatgaaggagacagtaatggacataacaacaagatcaacgatacaatcgaaaggacacaatcacggaaacagcattcaatatgccggtcataaaacatgagaacgtaaataacagtcaagtaggaatattcaccgcccaacgttctagaccccatctaaaaatctaatagtagagaacaccattcacaaaagaggatagaaaacacccataattaacatatggagctttactatcaccacataacaagttataaaacccaggaagcaaaaaaatcacatatagctaaatcacctacaaacaactatacaaacgagaacaccataaaatccaacaccaaaacaatagtaccacaatgtaagaaacatggatacacacacccaaaggaagtaccattgattaccccaatagaagcctgccccagacaaactagtacctatgaccacgcataggattagataacaaaatcgatcaagagacaaaacagcaacatgacatcatatacaccaacaactgtcatgtgttgaccacacagatccactattacacacccactcacactcacacccgcacatttagacaaggagttagcatagatagctagacagaacatggaattacacatacacactagacacaacgatcgatagtgacgcacaacatgaaactactacagtagacagtgagcctataaacaaccagcctacacaaaatatgagacgcgaatcagaacccgtacatcacaatgc

SEQ ID NO: 80934 - DNA, 469 bp, Homo sapiens
aggggccattattttgtagcgtcaccaaagtgccctagaagctggtgggagtgggcaggcaccctagggtgatcactgcacctgtcagtgcccctgtttcctcatccacactatgggggctgcctctgtcccaaagctagcactaagattaatgagacacctgtgctgggcccagtgtgggcttcacctcttaggaggagggtctaggaagtctttggggatctgacctctgatgctcgctctgagggccgcagcacctcccctcctcccttgccccccttgccccatcaacggaatgtgccccttccctgtcccccagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtac

SEQ ID NO: 80935 - DNA, 855 bp, Homo sapiens
  misc_feature (212)..(212): n is a, c, g, or t
gggccgagccgcaggcgctgcccgagccgcgggcgctggagcggctgtcggcgcggtggcaggcgggagccaggagtccggggctcgggcgggcggagcgcagcgcggggacgcggcggagcgggccccgcggctcggcgggggccggcagacaggtgtgccggcggcgggcggctcgcacgcaggcggctccaggcctccaccggcggtcnggaggggaggcgggaggcgagcgaggacccgcgcccgcagtccagtctgtgcgcgcccgtgctcgcttggcgcggtgcgggaccagcgccggccacccgaagcctagtgcgtcgccgggtgggtgggcccgcccggcgccatgggctcaggatgccggtgcggaggggccacgtcgcgccgcagaacaccttcctggacaccatcatccgcaagtttgagggccagagccgtaagttcatcatcgccaacgctcgggtggagaactgcgccgtcatctactgcaacgacggcttctgcgagctgtgcggctactcgcgggccgaggtgatgcagcgaccctgcacctgcgacttcctgcacgggccgcgcacgcagcgccgcgctgccgcgcagatcgcgcaggcactgctgggcgccgaggagcgcaaagtggaaatcgccttctaccggaaagatgggagctgcttcctatgtctggtggatgtggtgcccgtgaagaacgaggatggggctgtcatcatgttcatcctcaatttcgaggtggtgatggagaaggacatggtggggtccccggctcatgacaccaaccaccggggcccccccaccagctggctggccccaggtaagtgtacttgctttagg

SEQ ID NO: 80936 - DNA, 3185 bp, Homo sapiens
ggccggctggaggagctgaggttccgagtgcggccgctgctgggctggcgggcgggcagagcacggcaccctggcagcagggcccacgccacggggccatgggcagctcgagccaggcaggctgctgcccacgcttactgccagggtgaccccagccctggggcccagccacaaccaccctggcttcatgccaggggctgctctggttgccagtcggccagcctcgggggtgcagcctgggctgggactgctgctggggtgcaggtgaggcagtggccgggccctcaggccccagggcaggcaggctgcagggagccaagtcctccatggcggccccagccgggaaggcgagcaggacaggggctctgcggcccagggcccagaaaggccgggtgaggcgggccgtgcgcatctccagcctcgtggcccaggaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtacgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctggggaagaatgacatctttggggagcctctgaacctgtatgcaaggcctggcaagtcgaacggggatgtgcgggccctcacctactgtgacctacacaagatccatcgggacgacctgctggaggtgctggacatgtaccctgagttctccgaccacttctggtccagcctggagatcaccttcaacctgcgagataccaacatgatcccgggctcccccggcagtacggagttagagggtggcttcagtcggcaacgcaagcgcaagttgtccttccgcaggcgcacggacaaggacacggagcagccaggggaggtgtcggccttggggccgggccgggcgggggcagggccgagtagccggggccggccgggggggccgtggggggagagcccgtccagtggcccctccagccctgagagcagtgaggatgagggcccaggccgcagctccagccccctccgcctggtgcccttctccagccccaggccccccggagagccgccgggtggggagcccctgatggaggactgcgagaagagcagcgacacttgcaaccccctgtcaggcgccttctcaggagtgtccaacattttcagcttctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggctggagacccggctgagtgcagacatggccactgtcctgcagctgctacagaggcagatgacgctggtcccgcccgcctacagtgctgtgaccaccccggggcctggccccacttccacatccccgctgttgcccgtcagccccctccccaccctcaccttggactcgctttctcaggtttcccagttcatggcgtgtgaggagctgcccccgggggccccagagcttccccaagaaggccccacacgacgcctctccctaccgggccagctgggggccctcacctcccagcccctgcacagacacggctcggacccgggcagttagtggggctgcccagtgtggacacgtggctcacccagggatcaaggcgctgctgggccgctccccttggaggccctgctcaggaggccctgaccgtggaaggggagaggaactcgaaagcacagctcctcccccagcccttgggaccatcttctcctgcagtcccctgggccccagtgagaggggcaggggcagggccggcagtaggtggggcctgtggtccccccactgccctgagggcattagctggtctaactgcccggaggcacccggccctgggccttaggcacctcaaggacttttctgctatttactgctcttattgttaaggataataattaaggatcatatgaataattaatgaagatgctgatgactatgaataataaataattatcctga

SEQ ID NO: 80937 - DNA, 1429 bp, Homo sapiens
ggccggctggaggagctgaggttccgagtgcggccgctgctgggctggcgggcgggcagagcacggcaccctggcagcagggcccacgccacggggccatgggcagctcgagccaggcaggctgctgcccacgcttactgccagggtgaccccagccctggggcccagccacaaccaccctggcttcatgccaggggctgctctggttgccagtcggccagcctcgggggtgcagcctgggctgggactgctgctggggtgcaggtgaggcagtggccgggccctcaggccccagggcaggcaggctgcagggagccaagtcctccatggcggccccagccgggaaggcgagcaggacaggggctctgcggcccagggcccagaaaggccgggtgaggcgggccgtgcgcatctccagcctcgtggcccaggaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctccctcatgtacgctagcatcttcggcaacgtgtcggccatcatccagcggctgtactcgggcacagcccgctaccacacacagatgctgcgggtgcgggagttcatccgcttccaccagccccatctccccgcatctccctcaccagcctccactcagcactccagcaacacctcact

SEQ ID NO: 80938 - DNA, 393 bp, Homo sapiens
tgagggtaatagtttttaaataactgtagtgacatgctgtagaagaggcataggataattcattctgtgttgctccagaggcaaatctagaatcaacagataaaagttaaagaatcacatttaggttcaatgtaaaaaacaaactttctagaatcaatgccttatatggcagtgttcctaatcacaatgccaatgttaagcatacaactgctcatcacagaaagtacaatggacttaaagtgggtcagaagtccttggattctaatctcatcttgaccatttactagctgtgttatatgaggcaaggtatttacaacctctctgaatctcagcttttcttatgtatttatttacctcctgatatcactaagaggaataaataagatgatatgt

SEQ ID NO: 80939 - DNA, 971 bp, Homo sapiens
cctgtgtctgcataccctgatgttcggtgcccagcttagagaaggagaaggggcttacctactgcagacacctgtccactgagaggacccacttgtcatccctggtcaattacatgatcatgtctctggacttgccctgtgatgctggacaggagctgacagccgggatctgggagcaataccttcaggatagcacagcaaggtttagctgggcttgatctgcagtggtgtagaggctgcaaaggaggggcgattttgttatgtgagaaataagcccacctacttgtggggactcaagatgacttgtttggattctgcatatgcaaattgaagatctcctcctcttcttgagagttccaagacccacaactcacttttgcccgtgagtgtggagattgaaggggatggaaaacatgctcacctgggatgaataaagagaaagtcagtgagtaagtatttattatgaagcattagtttgtatcactcctgcacaaggtgctgagacatggccccagccagaaggaatttacagtccagtcaaaactgcctagaagtgtgacagcagctgagttggagggaggcagctgaaccaagaaaaccttatcagcactatttgaaacttttatctcatctggcttggcgcctgaggttctcccattaggggtccagcttcatccttttgcatgtggatatccagttctcccagcaccattcttcaaagaaatgagtgttttccccactgaatggtcttgtacctaagtttttactcagctcggtgaaaacgtgctctcactgatgaggctgataaggttttgtcttgaattgggacctgggaatagtgctggtaatttggagatgacatgaacatttatttggggctaccccagtgctctctgctggttgagcaactgcgccatccagccagttggaaggtttgtaatgagggagctgaatgagacagagacgagaag

SEQ ID NO: 80940 - DNA, 848 bp, Homo sapiens
ctgaaactaggtttggagcccttgtttgacaatggggaaaagtgcagctcagtgtatcgggtttgggcgatactgcggggaacagatagtaactgtatggcgttcatagtgctgatttgcctctgggaaacaggaatcttttccaggaaaaacagacctgacctagagcttttccagcttgagattttgggaaacaggagaatcacatgaggaacatatccaaaaactgctggtattgaagccatttctgattgctttaccagggaagattaggattaaggtaaaacggcaaaatcctccataattatcaaagaggtggtgagtggtagattttttttttgtcgttttgtttccaagcctcacagaaggatatggattacagaaagataaggttaaagggaagaagaaatcaatcttcaaagggcaaaaaagcgaaaaacagacatctcagaatccttgaaaagagcatcgaaaaggaacatctctgttgcttcaggctggggtattagtggaatgtgtggaatctatacagtcacccccaacatcaggtcgtccagaccatttgtcgttagactctgctgtatgtgccagtgtggtctctgaatttcttttcttttctttctttctttctttctttctttctttctttctttctttgaggtacggcctcgtcctgttgcacaggctagggtgtagtgccacagccatggctcactgcagcctcgacctcctaggctcaagcgatcctcccacctcaactttcccagtagctgggaccacaggcatgtgccaccaagttcctgggctcaatcgatcctcccacctcagcttcctgagtagctgggacc

SEQ ID NO: 80941 - DNA, 334 bp, Homo sapiens
aagctttgttggcagtatactaaaaggttctaggaatgcagtgattaggttttagtgggacatggagaatatgtcctactgaggacctgaaggaactgttgaggaactgaagatagaattattattgtagttcagaccttacattagggacaggtggaaataatttgcagcaccattaaatatgagctaaaaaatagggcagtgggagagggcaatgtttgaagctgtgaatctgtaaaggaaaaggttgtatcataattcatggtttggaaatgaaactgctcacatgctcagctacccggaatttcgtaatcatggttcatagctgttttcc

SEQ ID NO: 80942 - DNA, 363 bp, Homo sapiens
ataaaaccataagagacagtgtcttctgagtacagtctcgcttttaaaaaatctaaacatgcactgccctattttggatacagtgactgtagaaaaatttcccattggtaactttgggagggttttctgttgttgttgttgttcctttttcattgattatcagccagtataaattttaagctttctgtcaaatatttttctggagatgtcagtcttagggaaaagaaatcctaaagtgttatctgtaggagtctccttctcccaatttcaccccctccccgaaacctccacctcccaccccccaacacacatagtgttttttagatatcagtaaagtctttttctggtgtaactggagaggtt

SEQ ID NO: 80943 - DNA, 568 bp, Homo sapiens
cagtgtgcaagctcattttaagcttctgataatgtcactaatctgttagcatcctgttggtcaaggaaagtcacatgaccaagcacagcgccagggcagggaaatgtatttcacttttttatttgttttaattttttattatattttttgagatagagtctcactctgtcatccaggctggagtgcagtggcgtgatcacaggttccgtctcccaggttcaagtgagtattgtgtctcagaccccggagtagccgggattacaggcaccggccaccacacctgactaatttttgtattttcactagagatggggttttaccatgttgaccaggctggtctcaaactcctgacctcaagtgatctgcccgcctcagcctttcaaagtgctggaattacaaacgtgagctaccaggaccagcctatttcacttttttagtgtgagaaactgcaaatacttgtggcaaagggcatggatatggagaagagtgaagaaatagagccattaaaatactcttccccagtgggagaagggtgtatgaagagggagttgcattttttcctgctttg

SEQ ID NO: 80944 - DNA, 283 bp, Homo sapiens
aatgtctttctccttcaaaactcatgttgaaatttggttgccattgtaatagtattaagaggtggaacaacttaagaaagaagtaggccaggaggctctaccattatgggtggggttaattacattgcaaaaagatgaattcagcctctttttgttctctctcttatcttctacaatgtgatgatgtagcaagaagcctctcaacacatgttggcacctccatattgaaattcccagcgtccagaactgtgaactaataaatttcttcattgtaaatcaaaca

SEQ ID NO: 80945 - DNA, 921 bp, Homo sapiens
atgtaagggaggctctctttgctagcatgagtctggtgctcactcctcagccaatgaaatctcaccaaatttgtggagtttgggaagagtttgacagctactatggcagtcatgtggacatccttgagcagctgaagagatgccctgcccggagaggaggaatctagagaggcaatctggctacagtggctttgccgagctacagtgggctctacccagtttgaacctcctggcagctttgtttacactgtgaggggaaaaccatctacttaagcctcagtaatggcagacgctcctctctctaaggtcaagtgtaactgtttacttcagactgttgtgctggctgtgagaatttcaagcccgtggatctcagcttgctgggctccatgggggtgggatccactgagataaaccacttggctccctggcttaagccttcttttcagacacagaagaaagatgatgataagaagccatacattgtaagacatttaggctcactcaggtcattcacagttctgtttttcctttgactggactaagctccagctttgaatccaagtggtgcagttaacaaggaggagcaagaaagcaggacaaataaagcagagagctagtcaccagagggatgtgtttgatccagcacaccccttctcttcatagcagagaatcgacacccaatcaatcacagcaaagtacatttcacaaatttggagtaaacttttatgtgtactcaagggagatgtttagaaagggttatcttcgaagagacgcttcagaaaggagagagaatttggggaaccttttccatgatttgaagaagacggcaagaagcctctcaacacatgttggcacctccatattgaaattcccagcgtccagaactgtgaactaataaatttcttcattgtaaatcaaaca

SEQ ID NO: 80946 - DNA, 993 bp, Homo sapiens
atgtaagggaggctctctttgctagcatgagtctggtgctcactcctcagccaatgaaatctcaccaaatttgtggagtttgggaagagtttgacagctactatggcagtcatgtggacatccttgagcagctgaagagatgccctgcccggagaggaggaatctagagaggcaatctggctacagtggctttgccgagctacagtgggctctacccagtttgaacctcctggcagctttgtttacactgtgaggggaaaaccatctacttaagcctcagtaatggcagacgctcctctctctaaggtcaagtgtaactgtttacttcagactgttgtgctggctgtgagaatttcaagcccgtggatctcagcttgctgggctccatgggggtgggatccactgagataaaccacttggctccctggcttaagccttcttttcagacacagaagaaagatgatgataagaagccatacattgtaagacatttaggctcactcaggtcattcacagttctgtttttcctttgactggactaagctccagctttgaatccaagtggtgcagttaacaaggaggagcaagaaagcaggacaaataaagcagagagctagtcaccagagggatgtgtttgatccagcacaccccttctcttcatagcagagaatcgacacccaatcaatcacagcaaaggtgctcactgtgcctgacatttctattctacctaaaattaatcagcattgactgagcatctccctaggccagtacatttcacaaatttggagtaaacttttatgtgtactcaagggagatgtttagaaagggttatcttcgaagagacgcttcagaaaggagagagaatttggggaaccttttccatgatttgaagaagacggcaagaagcctctcaacacatgttggcacctccatattgaaattcccagcgtccagaactgtgaactaataaatttcttcattgtaaatcaaaca

SEQ ID NO: 80947 - DNA, 507 bp, Homo sapiens
ggaggatacagaggttgtgatgtatccaataaagcctgtgaagcccaacaggtttctcagaggaaggtgggagattgagtggcatatctatgtctacaacacaaaagacataccaagctgcacgtgcattcagtgactagaagctgtgagagcacagaggctccaccatcttgccctggaacaggactggaaaaattcttgctctagagctcctacagggaggccaaggcttcatcatgcctgcatcatggcttggcatcttctgtacaatgcagcctcctttccccttttcacaggtgttgattcctaataaattttgatccaccacccaaaaaaaagaaaaaaaaaaaaaaaaagaaacaaaaaaaaaaaaaaaagaaaaaaaagagagagagagagaggggcgggcgcgcggcatataagaaggtctctctcgccgcggcgggcggcgcccaagtgtagcggaggcacacccaggttttattgtagagaaggagggggacgaca

SEQ ID NO: 80948 - DNA, 464 bp, Homo sapiens
ggtaatgtttttacccataaatgtgaatacattttgaaattatactgcagaatatttttacgcaatataaagccaatctagttgtaaaatctaccattttgcactaggcagtgcctcatttctctcaaatttgtacaaagcctctattaatacaacatttatcactttaacaatttaaagaaagtaattgcaaaaccttactgattgttggagggctgcatgcccatttcccatggggactgatttaagcctctgtatctgcatgtgacatgcaaggatagttgtgccacatctaattgaaaatgctccttagtgctggagaagagttcaggaggctgggcgcggtggcttataacctttaatcccagcactttgagaagccaaggtgggtggatcacttgaggtcaggagtcaaagaccagcctggccaacatagtgaaaccccatctctactaaaaatgcaa

SEQ ID NO: 80949 - DNA, 240 bp, Homo sapiens
ctggtgatccacccgcctctgcctcccaaaatgctgggattacaggtgtgagcttctgtgcccagctttgatctgcttttattaatgaaatgttttttagggaccacagtgtggggcttgagagtgctgattgatttcactgtaatttacatttaattacagtttccctttgaacaatatgggtttgaactgcccaggtccacttctatgtgaatttttttcagtaaaagttacatgagt

SEQ ID NO: 80950 - DNA, 367 bp, Homo sapiens
gtataagcatgagagttttggaggtagccaccagaactgaaattaacccttgttgcctgtacttgtctctctcaatgagaccaatgagtgagaaactgttgctcttcattttatacattttgattcctttttgctttttttttttactatgtgcaaatattcctcagatttaaagataaactcaaaatatttaaataatttctttaactttcttattttccttactttagggtaaccttgagcaagtcagaagtataggtttaagcttgttggtgggtgggccctagcataggaaattccctcactttctcagagttcttaatgtctccagcatgttcttgataccactagggcagaggaaatgcct

SEQ ID NO: 80951 - DNA, 203 bp, Homo sapiens
tcaggtctttgcttaatgtcaccccatcagataccctttcttgaccactgtatctagaatagcatcatctattgctccttattcccttatcttgttttatcagccttatagctcttatcattatctgatggtatatattacgtattatttgcttattcactgtctgtaacatcctctagattgcaaacttcatgagtgtaggg

SEQ ID NO: 80952 - DNA, 732 bp, Homo sapiens
gaccaaatgctattcacctccaagtctgtcagagtccggagcctgggctcttcgttcaccatgctggacattttagttatgctttaatttcaagatatattcaattttctcatttttatacccttggaatcttgtcagatttcaatttttaaaaattagaaaatgggctatttaattaatataaatttaaaatatccccttttaacgtcaacagtcattgaatatgaatggatttgagtactccaatggtattttaggatactcagtatatctactggaaaaaaaatgacaaattgaatagctatatcactgtgaagtaagttctgtaataaaagtgagaataaaatgtggtgggagcacgaagtaaatgacaaattttctatccaggagtctctgctgtgagtctgaactcccagcacctagtgtaaagctgtactcatctatggtaactataggagacagaaatatgtccagctaatgctgcttaaaaggctttctggttttcttagaaaactgtgaatattcattctagacttttctgttgataaagagaagaaagactctgaagggagcttttgggggctcaatagataggaattagattggtagtccttgctcctaaaaggaagaagttgcttctttattaaactgtgtgattttttttgtttgtttgtttttgtttttttttttttgttttaaccagaaagagacaggtttgttcagtttggtatt

SEQ ID NO: 80953 - DNA, 567 bp, Homo sapiens
agaacaggtttaggaatggatctagatttacctggaagcttgctcctgtggacctgatccaggcccacggggcctggaggtgtggtgagataatgctgatgggatgagaaggtgatgaggagccagccagcactggcaggtgtcttcctagccctgatcttgttctccccagcgttttgaaagaggcggccagcagactctggggacctcagacgtctgtgctccacatgcgtatcggccgctctagagattgcctgggaagctggagggaatgggagacaccccggtgcagctgcgccctgagttctctgagcctggctcctggctccctgcagccctcccctccttgttcctgacccagagtgactttacctgtaccggctccctgctcgataggcctctgggtgcttaaattcttgaggggagcgatgcagtcggcaagggaacagataaacaaggtaatttcggatgggagcaggagcgctgctgtaatacaatgacggtgtgatacgggaacgggggagctgcacatagggaagggggaggccaggacctgggaggaactga

SEQ ID NO: 80954 - DNA, 895 bp, Homo sapiens
ggagttgatttgtctggccagaaagctgtacagcttgaccaacagcctcaggtagatatcccggctcttgggctccttgcgcggaacgttttttggtccttgttggggcggatgtcaactcccatgatggcgcctcctgctcggccagttccggaaagccaggtttctaatttctaacaagccccgggtgatgttgttaccaaggtccacctgccacagtttatagagggccgtggaggtgggagtggggtggggtaggcagaggagagaaacaggaggttgcagttgggacagctgtgctcatcctcacttgtaactgactctcgtaaattgtcatttaacttctcaacacccaccctcctccctcatcaatatgataaagaaagaacatcagaacatctgtgttcttggtctcccaggaaagcccacccagtcaggaccccaggatgtggcaggcaagtccctccctccccctgaagccccagtgactccagctctaggtgcttatgctggggtgggggcaggacactgtgaatctgcagctgctccccacattgttgaggggagcgcatagtatgtggggagaggtgaggagaggactttcctcttcctagaacttctggtctggtccccagggcacaggtgttaatgaagaaggaggaatggcctcttcctaatgggcctttcaaggcctgccagagccagcagggtgggcaggggacagggaggaacttgtgcttcccggcagggacaggaacccgctggatgcaccgctttgaccttggctcattgtaaacatgctctaatgtggggcgttgaagccaagagatgggacaattatcattgcaagggaagttatcttaaagttaatttataaattccagtcaaggtccta

SEQ ID NO: 80955 - DNA, 455 bp, Homo sapiens
gtctatcttatgaataaactttttacattaaagaataataataaacctttttcttaggtagtgggagaattgtttacctacattgtgttctatgagtatcactcattttggtgacactagtatgaatcctttaagcttccaaaggtcaatgaacagttactttgtagaagaggcatttcttgcttgcttctttgcagtgacttgttctttgcatgctaagtttctattgcctgtggaaagtctgggattgttttgttttcctggtagcatagaatgctgttcttcagatgcagtttattaatgctgtgaaatacttagactgctgtgaggagtatccataatgtctctttccagtctctgagttccaccactactaaagtttgttaatctaacccatgtgtttgattattcaagttgagaaaataaataataatgtaatcattaagtgtgccaaa

SEQ ID NO: 80956 - DNA, 394 bp, Homo sapiens
agtacacatatatttttaaatcttcaaaaacctctggaaaaaaatccactacaattcacataatatgtagggcatttaagttttaatgtttgctgatcttttgacctagagactgttaaaaaataatcccgtatcacaacaaggataatatgtccttaatagccttgatacatcttgccgaatccagttttcgttatgaaaattgtatagtgtgggtgaatcatatcataaaacatcattttacattttcatttgttctgcttacatttagtgaaaaactagttcagaaatgtagtgacatttgagtaccaaataatgttttattttgtgtgaaatctaaagtgctttcctcagcaggcaaagtctttgaatagcttctcattaagggattgcc

SEQ ID NO: 80957 - DNA, 348 bp, Homo sapiens
cagtgagccaagatcacgccattgcactccagcctggaagacagagcgagactccatcttaaaaacaaacaaacaaaaaaacccagctgaaatggcagatatgacccaccttcccacccagctcccaaccttcctcctcaggaagagctgggctctctgactgtgttgtttcctcggcaccatccctgtttctaatacagcccttattgatttgaaaggtaggtggtgtgcttaaaagtctcctcccccactaactgtaagtccctaagaacagggactatgacttgatcatctctgtagtgccagggcctagaaccttgcctgggacagggtagatgctaactcatt

SEQ ID NO: 80958 - DNA, 241 bp, Homo sapiens
cttctctcccaactctcacatccaaaccatcacttcctctccattttaccatctcgaatttctcacatctatgtctctccaccaccactacaaactttccagtctaaacaactgtcactttttgcctggactacatcaggagtctgctaacaggtttccctggatcttctcatgaccacctcaaataaactgttcaattatacagccaaagtgacctttttgaaatagaaaatctgtcatc

SEQ ID NO: 80959 - DNA, 361 bp, Homo sapiens
cttgtagtcatgctttggcctttctgatgtccagcccctgtcctcaagttacctatgggctgccagccatcagtcaactcattaatatacaaggatgccttcaggcatatttttctaggttattaatggaggttaaattcccagactagttacaaaaagtattttttaaattcacagtaaaactgtaatgttactttatattctaggaacaggatactgtgcaggaaagaccactgtcaaattcagagttttgttttgggaatgccttaccacttcattttcattccctcttagttctccagtcctctttctcaagtagctgatgttctcatatttctgtgagtacactttgcatcttcac

SEQ ID NO: 80960 - DNA, 443 bp, Homo sapiens
acagagatagggtctccttatgttgcccaggctggtctcaaactcctaagctcaagcaatcctaacaccccagcctcccaaaagtgttgaaattacaggtgtgagccaccatgcccggccaagttaccacacttcactgtgtacatcctttccccaccccactaaactggaatatatacacccctcagatatagcagttctacctcattccttatttttgtatctaaccctaatgcttaatgtgtctgacagagatagtaggtgtttaatatgccaacatttttgagttaattgattattatagcaggaataatggtggtgggcaatgccatctaattaaatgaatggtggtgagagggatataagatagtacttgcccctgatgcatttcagactgaaaaaggttgggttaagggccatcagaaggatctgctaacttgctg

SEQ ID NO: 80961 - DNA, 946 bp, Homo sapiens
gaaaagacaagccccagtgcacaagtgctttccaaacttctgcttgcctgatgtttcttaatgtctccttggctgaagcaatggccaagcccacattcaagagctagagacagagcttatacctgttgatgggaggaagagcagagtcacattgcaaaggggtatgcctacaattttggaaggaattcgtggacattcggcaatttcttacagacatgtgacactttcgggctgaagcacttaagagccagtgtgccctgtccatttctgtcttctgtcctgtggatttggaagcatgtgttgacagaacaatgtcttatggtgaaggaagcctaaacccctgagtcattggatggaggagagcccatgttgacccataaaggacttcatatttgtccacgtctctgccctggttcaaatccttcagaggctccccatctaccacagggatgatctttctgaaatggatttgggcatgccagtctcctggctgaaacaggcctcctgggtccttgtcactcaaaggaaaaggcaaactcctcaagacttccacataatggccaccttcccaaaccaggctctcctactggcatctctctcctaaacctaacttccaaagcctacttggggttcagcctcacatgctggagtttccccatctctgagacttcattcaggccagttccttctgggcttcggaggggttctttgttcctaaagttccatactttaagaacctagcctgaaatatcagggttctgggactctgcaggtgaccacgagccactggtgctcctgcgaatggcccacgaaacctggtggcagaaaccccggcttcacacctaaaatggatctctatgagtgctacaatggagtccctggggcctgctggtagatcccgaatcggatgaagtcggaacaggagaggagcacaaaagcggaaaga

SEQ ID NO: 80962 - DNA, 528 bp, Homo sapiens
cctacgtttccgtgttcctcggttagtgcaatttcatgaacagcattgccatttggtggacgttacgcacaaatggctccccttcgctgcctctttcaatcttgcaggactaatgtgtcctgcttggatgaataatatccgacagtcagcgtgaaggcacaggcgtctgagcttggctcaggctgtgagctgtggggccttgggcaagctacttgaacttgccaaacttcagaatcctcatctgcaagatgggaagcattgtattatgtttgccacatgggctgttgcaggaataaaatgaagggttatatagacagtattagcacagtctccggtactcattaagagctcaataaatgtctgttgttgatagcagcattaaagcagagtaatagagggccaccctataaacactgtcaattgctgtaataagatccaccattcctaaacagcactgcggttgctcatccttcaggttgagtcagggtttgctgggggccctggcatccttgtagcaggaataaacac

SEQ ID NO: 80963 - DNA, 781 bp, Homo sapiens
gtcataggcgaaggcctctgggaaggtggaggccggcagggcggaggcggagcccgggaaggaaaggtggaaccagagggcagaaggcgggacctaaggagaggcgatttttacaggaagttgctgcctgtcctggacccatctggggattactactactggtggctgaacacaatggtcttcccagtcatgtataacctcatcatcctcgtgtgcagagcctgcttccccgacttgcagcacggttatctggtggcctggttggtgctggactacacgagtgacctgctatacctactagacatggtggtgcgcttccacacaggattcttggaacagggcatcctggtggtggacaagggtaggatctcgagtcgctacgttcgcacctggagtttcttcttggacctggcttccctgatgcccacagatgtggtctacgtgcggctgggcccgcacacacccaccctgaggctgaaccgctttctccgcgcgccccgcctcttcgaggccttcgaccgcacagagacccgcacagcttacccaaatgcctttcgcattgccaagctgatgctttacatttttgtcgtcatccattggaacagctgcctatactttgccctatcccggtacctgggcttcgggcgtgacgcatgggtgtacccggaccccgcgcagcctggctttgagcgcctgcggcgccagtacctctatagcttttacttctccacgctgatactgactacagtgggcgatacaccgccgccagccagggaagaag

SEQ ID NO: 80964 - DNA, 363 bp, Homo sapiens
cattctgtcctccacactcagggagatgtcttgataccagaggtaaacagcaagcacagacaaatgaatgtgctgccatgaaacctaacagttcataaggtgaggatccatttctcctatgcatctggcacaccgcagaagaattctgtctccaggagtgagtaactgcttgtgacagaactgtgtcccaaaccacaggctctgagattttgcagtggcacaggcagaaaagagcaggtgttctcagaaaaatcatctttaaataataaagcaagaagaaatgatcaaaaacacaggatactcaatagcccataaacataatacttctcacctgatgacattaaactctgaaaataacaaact

SEQ ID NO: 80965 - DNA, 386 bp, Homo sapiens
ttgaatgtgggccagacctagtgattgacctctaatgaatagaatatgacaaatggcacatatagctgtcagttctgagattaggttacagaagactgtggcttccttctttggctgttctgtcttgttcttttgcacactttctccgaaggaagccagctggcatgttgtgagcagctctatggaggggcatttgtgcaagaaactgagaatagcatctgacccacagccagtgaggagccacagtcctcagtccaacaacctgtgaggaaaggaattctgccaataactatatgaatgagcttggaagtgaatcttcccccagttgagctttcagatgagtcctcacctcaggcaacctcagtgtacctgcagcctcacgaaag

SEQ ID NO: 80966 - DNA, 2785 bp, Homo sapiens
  misc_feature (1048)..(1048): n is a, c, g, or t
  misc_feature (1464)..(1464): n is a, c, g, or t
  misc_feature (1834)..(1834): n is a, c, g, or t
  misc_feature (2455)..(2455): n is a, c, g, or t
caaaaaaagcccacaaaaatcagtaactcaaccccttttacaatagctgcaaaaaaaaaaaaaaaaaaaaggaatacctaatcattaagcactttggaaacaaattaatattttggaaagtattcagatttttttcctctatgtgaaaggtaaatcatgataaatttatttcttcttttgtctcttgggtcaagaaaagcactaatttaatgtcttctattagctgtatctttttttctgtcaccccagttttcatttcaggttaattgaagtgtgggttttccaaattggtttttgcttaggctcagtaaagttgatccattagctctgaatttctttctatacatacttcgaaagctagagttattgaaaggagtaattttttccatttaaatgtactttgcttattatttcccaggttctgatagcaatatactgctcagtgggaaaagatttctcctgtgattgactgttcctagcactgtgtttaggaaatttctttcaaatttttctcttaatatttttctagtgctgagatcctgtggtttgaaggacttttatttcagagacataggccatgcttagtggagactcattcacaatggaaacaaagcttagatgctgattatccaaataccccattttgaatatgagacttcttactgaaaggacaatttggagagatatatggtcaaatgactaggctaaatttatctatattcatttcctaaacaatgtaggtaaattgcacattttaaaatattccagcatctcaaaacatggcacctaccatcaatatttctaataatcattcacttgttcagcacatatacagcacttaaccacatgaatgctttgtaaaagtctaggggaacatgagaaataagtcagacacagtccctgttgtccccgtttacaatctactgtgagacacagataattaagaaggtgattataatcatgtgggaaaagcagttcttactgtagattcagacaagagattctagattttcaagggatctacatctcaaacccaaagaagtaaatncccaaagtgctgggattacaggtgtgggccaccatgccaggcctattttttgattttttggttatggccattcttccaggagtaaggtggtatcgcatcgtggttttgatttgcatttccctgattattagtgatgtcgagcattttttcatatgtttgttggccatttgtatatcctcttctgagaaatgtctattcatgtccttagcccactttttgatgggactgtttggttttttcttgctaatttgtttgagttcattgtagattctgggtattagtcctttgtcaggtgtatggattgtgaagattttctcccactctgtgggttgtctgtttactctgctgactgttccttttgctgtgcaaatgctctttggtttaattaagtctaaactatttatctttgtttttantgcatttgcttaaatgggttcttggtcatgaaatccttgcctaagccaatgtctagaagagtttttcctatgttgtctctagaagttttatagtttcaggtcttagatttaaattcctgatccatcttgagttgatttttgtataacctaagagatgtggatccagtttcattcttccacatgtgacttgccatttttcccagcatcatttgttgaatagggtgtctttcccctactttacgtttttgtttactttgttgaagatcagttggctgtaagtattagggtttatttcttggttctctattctgttccattggtctatgtgcctatttttatgccagtatgatactgttttggtgactatggncttatagtatactttgaaatcaggtaatgtgatgtctccagatttgttctttttgcttaatcttgctttggctgtgcgggctcttttttggttccatatgaattttaggattttttttttctaattctgtgaagaatgatagtgatatttggaggggaattgcattgaattgtagattgcttttggcagtatggtccgtttcacaatattgattctacctatccacgagcatgagcttggggtgtgtttccatttgtttgtgttgtctatgatttctttcagcagtgttttgtagttttccttaaagatgcccactgtcaccactcctcttcaacatagtactagaagtcctagccagagcaatcagacaagagaaagaaaaaaagggcatccaaattggtaaagaggaagtcaaactgttgctgtttgccgatgatatgattgtttagctagaaaaccctaaaggctccttcagaaagctcctggaactgataaaataattctgcaaagtttctggatacaaaatcaatgtacacaaatcagtagctcttctatacaccaacagcgaccaagctgagaatgaaatcaacaactcaggccgggcattgtctctcatgcctntaatctcagcactttgggaggctgaggtgagcagatcacctgaggtcaggagtttgagaccagtctggccaacacggtgaaaccctgtctctactaaaaatacaaaaattagcggggctgtgatggcgtgcctgtaatcgcagctacttgggaggctgaggcaggagaatcacttgaacccgggaggcagaggttgcagtgagctgagatcgtgccactgcactccagcctgggtaacagagcgaggctccatctcaaaacaacaacaacaacaaaacaacaaaaaaagcccacaaaaatcagtaactcaaccccttttacaatagctgc

SEQ ID NO: 80967 - DNA, 726 bp, Homo sapiens
ccatttttcaaaggcagaagagaagaaagttttggaaagcaaaaaacttacaacacataccattaaagaaaggcaagagagttgttagctaaactgatctgtctgcatgatagacagtttaaaaattcatcccagttccatatgctggtaacttacaggagatatacctgtattatagaaagacaatctgagatacagctgtaaccaaggtgatgacaattgtctctgctgtgtggttcaaagaacattcccttaggtgttgacatcagtgaactcagttcttggatgtaaacataaaggcttcatcctgacagtaagctatgaggattacatgctacattgcttcttaaagtttcatcaactgtattccatcattctgctttagctttcatctctaccaatagctacttgtggtacaataaattatttttaagaagtaaaactctggggctggacgctgtggctcacacctgtaatctcagcactttgggaggccgaggcggggagatcacctgaggtgaggagttcgagaccagcctggccaacatggtgaaaccatgtctctactaaaaatacaaaaaattagccaggcgtggtgacagtggcacctgtaatcccagctacttggggggctgaggcagaagtttgaacccaggaaacaggttacagtaggccaaaattgcgccactgcactccagcctaggcgacaacagcaagactgtgtcc

SEQ ID NO: 80968 - DNA, 223 bp, Homo sapiens
  misc_feature (122)..(122): n is a, c, g, or t
gacagcaataaacccaggttaggcaggggcagcacctgtgggtctgggctccacaccatgcctggacagtgcaattagaggagtgagaggcattgagatgatcctggtcctcaccaggtatnaccagcatctgagcaggggctaagcagcaaattccatgtggtttcgtgtggcatggacatgactgggagcagggccagcctgctcctgagacccccctcat

SEQ ID NO: 80969 - DNA, 114 bp, Homo sapiens
aacaaacaaacaaataatcagatacctgagtgaagtgggttatgggggtggtagggacaggactcaccttccttgagggacccagaagacttgtgaggcctatgaatgatggct

SEQ ID NO: 80970 - DNA, 537 bp, Homo sapiens
gggaaaattgataagacgacttgaggcactgatgatgctctcaactttgggaagtagcagaaggccccactcctgggcaacatggcaaaaccccatcaaaaaaaaatgaaagaaagaaagaaaaattagccaggcatggtggtgcacacctgtagtcccagatactcgggaggctgaggtgggaggatcacctgagcccagggaggctgaggctgcagtgagccatgatcatgccactgcactgtagcctgggcaacagagtgagaccctgccaacaaagcaggaaaaaaataaaagcctttctgaggaggtggtaaggagccaaccctgcaaaggcttagggaatagtgctgcagacagaagggatgcgcaagtgaaggtcttgaggctggaaagagtttgatgtgtttcagaaactgaaatgaggccagtgtaaaggtatggaggggaagacaggaaggaactgggtcctgtgggcctcagtaagccagagttagagagttggggctttgggtattctcctttgagcagtaggag

SEQ ID NO: 80971 - DNA, 869 bp, Homo sapiens
gggactacaggcgtgcgccaccttgcccggctaatttttctatttttttgtagagacgggttttcgccatgttgcctcagctaaaatgtctcaaaatctcctcaactaaaatgtctcaaaatctcagcctcccacagtgctggatgacaggagtgagccagccagcatcatgcatccctgtgcgccctgccagggctggcgggaccctcccacccttgttgatgggcagtgctagattatttgtcacgaatcatcccctacaaacaatgatttccctccgcttgcactctctaactagagccatggatggccaaatgctttttgggaagaagccaatggattctcctcggctctgcctgcaagtaacaaaggcttttgactccactccctccacgctgtcagatcgccattccccttcaggaaaacttcgaatggggctgtggacctcactccccaaaatgtcacaacacatgtgcagcaccccgacattcagaaccatgaagggagaaggtggctggtgtctgtaggagggacaggtgtccgtcctgggccagtgtcaggccagcaggtgcagggacagatgggccatccacattctccaagattagcttctacctcaaccagcacacctcagcaagatgccaggattgggctccacaggcagccatgaaatgggtttctggaggaaagatcagcacaggaaaaggggtcagtcaggtcgcaggcaaagtgctagggaaatcccatctcatgcagagctcccaccaagaggagcgtgagttgtgctgtcctggctcgagaagaaggcagcacaggatctgtagctgagggtggccctcccaccaggggacgctggtcagtgcctctcc

SEQ ID NO: 80972 - DNA, 555 bp, Homo sapiens
accattacagctacaggagacggaagtaggggagagagaaggcagagtggcacaattagcaggaagcagaaaagaactgacaattacaggcaagtgctgagcccagggaggcaggatgcagctcccatcaaaggccagaggggcaatgcagaaaggaggaatgaggcatccggagggcgtggattttaggagcaactgctgtgcaaataagcttgcagaaagaaggtgagaggtctaactacaaatgtaactgcaaaaaggtgaaagaggccaggagttcaagaccagcctggccaacatggcgaaaccctgtgtctactaaaaatacaaaagaattagccgagcgtggtggtgtatgcctgtagccccagctgccagggaggctgaggcaaaagattgcttgaacccaggaggtagaggctgtagtgagctgagatcacaccactgcactccagcctgggagacagactctgaaaaaatactactaataaaaaagaacaaataggttctaacgacaaatttatttctcacttatagaggctgggaagtctgaag

SEQ ID NO: 80973 - DNA, 355 bp, Homo sapiens
ggcagagaggtgctcgagtgctctggacgcccaaggagtttaactctgactggccagcagagggcagggacaggaagggtgtctccatgcaagcgtgccgattttacaagatggcgtccagtttggtcaaaacagcccagaaggcttgcctcaggaacaggcctgctgcggacacccccaggagtgagggtacaggagaccatggaaaggcatctaagatgacaagcttggctgggggaacaagacaatcctcaaggtgagaattacaacttccagcattattgtagacatagcataaaaaacattcatcaaacccactgccaaaggaattgtccttaaatacaagtccgtaaac

SEQ ID NO: 80974 - DNA, 135 bp, Homo sapiens
actggatggacggtcactgatggcctggccactgccactggtccagccatgagtctgggctggggacgcccacacctttggatattgactcagcacagggttactgatcccctgggttaagagggcaccccaggc

SEQ ID NO: 80975 - DNA, 1907 bp, Homo sapiens
tccggcgtccttccctctcagggaagctccagctgtccctcccgcagttggccctgtggtgttccgaagccggttacgtacggcctgagggccaggcgaacctcaggctctttgtcctactaaaaagcgcacgacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaaga

SEQ ID NO: 80976 - DNA, 220 bp, Homo sapiens
gcggccgcctactactactactgctcgaattcaagcttctaacgatgtacggggacatgacctttactgtgttagctctttgaatgttcttgaaattttagactttctttgtaaacaaatgatatgtccttatcattgtataaaagctgttatgtgcaacagtgtggagattccttgtctgatttaataaaatacttaaaatacttaaacactgaaaaaa

SEQ ID NO: 80977 - DNA, 967 bp, Homo sapiens
tagaggatcccggacgagcatctttacatattctggaatcccagcagtttctttctgtttttgcgaggtaagtctgttcatttaaatgacaaatggagagaggctctctaaaaggaagtgatctgtatttgggaatagggcattgcaatgggaatgcctgtgctatagtcaactatgtacatattcagaggagtaaaggaaaacaagtttttaaggacaaatgacgaggattacaaaattactttgaggtaattattcttggctaccaagatcaataacaaggatgacaccagtccaaggttgacaggcagttgctaggcagattttctcacgagagaagttttttggtgcaaggttgcagtggcctttgtgtaaggttgtagtttttgtaaaaaggaaaaaaaaacccttaatccttgttatcagacatacaagggtgagacccttctcttcagggttgcatttttgttaacactagtgactccattttgattttgacaacttgcacatatcttagttgttgggttttttttgtttgttttttgttttgttttttttttttttttgacaatggtgacttgctctgtcacccaggctggggtgcagtggcccgatcatggctcactgcagcctcaagcagtcctcccccttcagcctccaaactgtttggattataggcaagagctacttactacacctggccatggatcttcttgtgtcaactttgagaccaaatttactgcagtgcttaaaatgttttaagaagttatacacatgtgctggatgtggtagctcacgcctgtaatcctgtagcaggacaagccgcagacaaatcccctcagacaccgagttaaagaaggaagggctttatttggctgggagctttggcaagactcacgtctccaaaaactgagctccccgagtgagcaattcctgacctttttaagggcttacaactaagggagtc

SEQ ID NO: 80978 - DNA, 274 bp, Homo sapiens
aaatagaggatcccctaaatggctgttatggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagccattaggtacagccatttaggta

SEQ ID NO: 80979 - DNA, 1444 bp, Homo sapiens
atactgtgcttttacctttctactgatgtgctaattctagaaaagtttagaagctgattatataagtcctttcttcctcttttttcttttttaaagatcactatgttgtagttggggcccagagagatgcatggggccctggagctgcaaaatccggtgtaggcacagctctcctattgaaacttgcccagatgttctcagatatggtcttaaaaggtagagtacaaattttgattcttttgaatattggtgcactgcatacagttctagatgttatactgtgctttgctcactttgcctgcattcctgtggttctcatgctagactctagttcttaaatacaaggcagattgtcttttgttgtagctgccttttcctttgaaacagctttccataaagtgtcttaactgtgctagaaatcaccagtttctttgagacagtggagttactgagccctagtgcttagtgtggtggatccagagtgataaggtggatcatagtccctaagcaatctatttgaaagcagtagcatacctctctactcatgtactgaggcctaacagctattgaaattttgttctgtttattcatttattcattttttgagacagagtttcactctgttgcccaggctggagtgcagtggtgtgatctcacttagctcactgcaacctctgcctcccgacttcaagcaattctcctgcctcagcctcctgagtagctgggattacaggcacccacaaccacacccggccaatttttgtatttttactagagacagggtttcgccatgttggccaggctagtctcctgacctcaagtgattcacccgcctcagcctcccaaaatgctgctagtgagccaccgtgccctgcctcttttgtttatttttgagcctttctgtcctactttccactctttcacactcctacccacccacacattcaaaatcacgtcacattcttgaatctttgggtcttagggcaaactgcaatgcttaactttaatacagagtacattaatggagaaaaagatacagtgagggaagtgggagggatggagggcagtgtgatacatgtaacctcaaaaggtgctgtcacaaatatagtttctctgcaaactcttcttgtaacttaaatttgtgaatttttattttattttagaattatttttttaaaaatccaatgtttggatttacctctgaagatttttctcaagatgtgcatcatcatgcttacactgttttcaatgatctctgggtccagaagttaaggaactccaagaatgaaattgtgaaagggtgactactggcccctgctatgtactcaaaatcttatttgcagatctcctatcttgctctttgtaggttacttaaaaaaaaattattcctattcttttattcttttacctggggtctcaaaaaaagattttgttagtttttttt

SEQ ID NO: 80980 - DNA, 338 bp, Homo sapiens
tgctgggattacaggggtgagccacttcgccgggctgagagtaagttttgtttatatgtcctcttaatctgtaacttcactggacaggagtaaaccctgggcaaggaacaataactcagaacttacgcctgctttctgattctaggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccaggtaaagaccgccccccccccccgccccgctttttt

SEQ ID NO: 80981 - DNA, 869 bp, Homo sapiens
tcccgggttcatgccattctcctgcctcagcctcccgagtagctgggactacaggtgcccgccaccacacccggctaattttttgtatttttagtagagacggggtttcaactgtgccagccaagatggtctcgatctcctggaccttgtgatccacccgtctgggcctcccaaagtcctgggattacaggcgtgagccaccgtgcccggcctaactgctctgatatttttaaaaaaggtgacttggattaaagtatgcaaactcaaggagtagtacgagcccacttgagtgaagttagcttagttgctaaagagcttgataccaaaattacttttgtttacttgatgaatgggatagttgttgcacagggccactgatctagattactgtcttatttgtcaagtacttatagttgtagaagtagcagtgtgaaaattatcggaatggagaaggggcaatgataaaacaatttattttcaggtaccagcaacttcaaggtttctgccagcccactgttgtatacgcttattgagaaaacaatgcaaaatgtgagtatatacctcattacaaaaatgtatgacttaatttttgttgaatcaacctgagataaaaaacactgatatgtaaaccgtagtcagtaacaaaaaataggaattgagaataaattttatagcagcgttatttaagggatacttgcctattgaaccatatgagatgagggctccaatcttaaagaatatgttgtttatttaggaatatataacaaaatgccatgaggcctaagctgtagtgcaggggcccacaggggattgtctatagagtcacaatgctaaggaaggcttaaatcaacttgaactatactttgaga

SEQ ID NO: 80982 - DNA, 1377 bp, Homo sapiens
tctcaaacttctgggctcaagtgatcctcccagctcggcctcccaaagtgttgggattgcagttgtgaactaccccacccggcctaggcccacttttaaaatgttaattaagaagaaaacattttttcctcaccataactaaaggaactgacaacatgagcctagttagtaataacttaaagttgagattgttttaactatcataaataatttcttttcaagaagatataatacaagttttttatttaaaaattgttatagagtaacatgttagtgactagcctgaataaataagttccaaaaggttagttttaatgataatttcttatcttacaggtgaagcatccggttactgggcaatttctatatcaggacagcaactgggccagcaaagttgagaaactcactttagacaatgctgctttccctttccttgcatattctggaatcccagcagtttctttctgtttttgcgaggtaagtctgttcatttaaatgacaaatggagagaggctctctaaaaggaagtgatctgtatttgggaatagggcattgcaatgggaatgcctgtgctatagtcaactatgtacatattcagaggagtaaaggaaaacaagtttttaaggacaaatgacgaggattacaaaattactttgaggtaattattcttggctaccaagatcaataacaaggatgacaccagtccaaggttgacaggcagttgctaggcagattttctcacgagagaagttttttggtgcaaggttgcagtggcctttgtgtaaggttgtagtttttgtaaaaaggaaaaaaaaacccttaatccttgttatcagacatacaagggtgagacccttctcttcagggttgcatttttgttaacactagtgactccattttgattttgacaacttgcacatatcttagttgttgggttttttttgtttgttttttgttttgttttttttttttttttgacaatggtgacttgctctgtcacccaggctggggtgcagtggcccgatcatggctcactgcagcctcaagcagtcctcccccttcagcctccaaactgtttggattataggcaagagctacttactacacctggccatggatcttcttgtgtcaactttgagaccaaatttactgcagtgcttaaaatgttttaagaagttatacacatgtgctggatgtggtagctcacgcctgtaatcctgtagcaggacaagccgcagacaaatcccctcagacaccgagttaaagaaggaagggctttatttggctgggagctttggcaagactcacgtctccaaaaactgagctccccgagtgagcaattcctgacctttttaagggcttacaactaagggagtc

SEQ ID NO: 80983 - DNA, 1076 bp, Homo sapiens
cagctaaagaatttattttggatggggggactagcacgatagaacagtctattctttaaaacactttctaaagacacattctttgtctttgcagtgagaaactcactttagacaatgctgctttccctttccttgcatattctggaatcccagcagtttctttctgtttttgcgaggtaagtctgttcatttaaatgacaaatggagagaggctctctaaaaggaagtgatctgtatttgggaatagggcattgcaatgggaatgcctgtgctatagtcaactatgtacatattcagaggagtaaaggaaaacaagtttttaaggacaaatgacgaggattacaaaattactttgaggtaattattcttggctaccaagatcaataacaaggatgacaccagtccaaggttgacaggcagttgctaggcagattttctcacgagagaagttttttggtgcaaggttgcagtggcctttgtgtaaggttgtagtttttgtaaaaaggaaaaaaaaacccttaatccttgttatcagacatacaagggtgagacccttctcttcagggttgcatttttgttaacactagtgactccattttgattttgacaacttgcacatatcttagttgttgggttttttttgtttgttttttgttttgttttttttttttttttgacaatggtgacttgctctgtcacccaggctggggtgcagtggcccgatcatggctcactgcagcctcaagcagtcctcccccttcagcctccaaactgtttggattataggcaagagctacttactacacctggccatggatcttcttgtgtcaactttgagaccaaatttactgcagtgcttaaaatgttttaagaagttatacacatgtgctggatgtggtagctcacgcctgtaatcctgtagcaggacaagccgcagacaaatcccctcagacaccgagttaaagaaggaagggctttatttggctgggagctttggcaagactcacgtctccaaaaactgagctccccgagtgagcaattcctgacctttttaagggcttacaactaagggagtc

SEQ ID NO: 80984 - DNA, 441 bp, Homo sapiens
ttcgagctcggactccgttggccaggctggtcttgaactcctgacctcaggtgatccacccatctcagcctcccaaagtgctaggattacaggtgtgagccaccccgcccagcagtatgtgtcacttttgtctactcagaacatagtggttcgtacttataattgcagcactttgggaggccaaggtgggaggattgttagaggccaggagttcaagaccagcctgggcaacatagggtgaccttgtctctacaaaaagaaaaaaaaagaattatgtatataacaaactttaaaaaggatcccacttaatttagctgtcatgtaaactatggttaaataccttttctagaaaagtgataatgtattttaaaaatctaatgtatcatttagcctggtaataggaagctcactaatctgatacagtagtatctttttcaataa

SEQ ID NO: 80985 - DNA, 5595 bp, Homo sapiens
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaacaacaaaaacgaaaattgcggggcttcatatgcagggggtgggaacaaaaggaggttttgaatgtggccatgtggcatagggtgtttcttgaacccaagttttttggttaaagagggg

SEQ ID NO: 80986 - DNA, 5542 bp, Homo sapiens
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacctgggaaaaaaaaaaggcacatacacaccacacacaaaaaaaaacacaaccaaccaacaaaaaaaggggggggtacacc

SEQ ID NO: 80987 - DNA, 5487 bp, Homo sapiens
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaagagagagagagagagagagagagag

SEQ ID NO: 80988 - DNA, 5501 bp, Homo sapiens
  misc_feature (5498)..(5498): n is a, c, g, or t
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 80989 - DNA, 5527 bp, Homo sapiens
  misc_feature (5524)..(5524): n is a, c, g, or t
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccatttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 80990 - DNA, 5492 bp, Homo sapiens
  misc_feature (5489)..(5489): n is a, c, g, or t
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaagtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 80991 - DNA, 5507 bp, Homo sapiens
  misc_feature (5504)..(5504): n is a, c, g, or t
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacaagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 80992 - DNA, 5252 bp, Homo sapiens
  misc_feature (5249)..(5249): n is a, c, g, or t
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacatttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 80993 - DNA, 5147 bp, Homo sapiens
  misc_feature (5100)..(5100): n is a, c, g, or t
  misc_feature (5134)..(5134): n is a, c, g, or t
  misc_feature (5139)..(5139): n is a, c, g, or t
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacaccacgttacctttaaattgaaaaagcatgttgggcattgtttccatccgttattaaccaccaaattantgaaattaccaggggcattgccattttttgccanccaanttgaaatt

SEQ ID NO: 80994 - DNA, 937 bp, Homo sapiens
  misc_feature (934)..(934): n is a, c, g, or t
ctctaaggatctctactaaatggctgtagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 80995 - DNA, 1074 bp, Homo sapiens
  misc_feature (1071)..(1071): n is a, c, g, or t
caataaggttagtctgcttgttgcatgaagattattataacgttggttgaaaatgtgcgacaatttaatcgtccatactatacaataggtgccctatcttagatgatatgtcgcatgactgtggggctcgtttagtactcaaagagcaactatggaacctaccatttatgtggcaagatgtgcgtctgagctatacggtagtcaccctgaaccagtcagaacacgttctcggcttgccattactaagagatctagactatgtagagtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 80996 - DNA, 4460 bp, Homo sapiens
  misc_feature (4460)..(4460): n is a, c, g, or t
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaggtttcttccagtcctctacttan

SEQ ID NO: 80997 - DNA, 2687 bp, Homo sapiens
gagctcggtaccctgtctccgtttcgggacgttaagagccgaagtatttcatccccccccccgagagagcgtctgtctccgtttcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttcctaggttttcccatgtcacga

SEQ ID NO: 80998 - DNA, 446 bp, Homo sapiens
  misc_feature (443)..(443): n is a, c, g, or t
tgagctcggtaccagttacacagctcagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 80999 - DNA, 2415 bp, Homo sapiens
gagctcggtaccctgtctccgtttcgggacgttaagagccgaagtatttcatccccccccccgagagagcgtctgtctccgtttcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtgggggaggggagactggagagttattgtttgatgggtatagaatttcattttgcaagatgagaagacttctggagatagatggtggtgatgatggcacaccaatatgaatacactaataccactaaattatactcttaaaagtgattaagatagtaaattttacgttgtgtgtattttaccaaaataaaacatggtggggggctgggtggggggaagcaataagagaaaaaagactggttaaagg

SEQ ID NO: 81000 - DNA, 3072 bp, Homo sapiens
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaaggtagagtacaaattttgattcttttgaatattggtgcactgcatacagttctagatgttatactgtgctttgctcactttgcctgcattcctgtggttctcatgctagactctagttcttaaatacaaggcagattgtcttttgttgtagctgccttttcctttgaaacagctttccataaagtgtcttaactgtgctagaaatcaccagtttctttgagacagtggagttactgagccctagtgcttagtgtggtggatccagagtgataaggtggatcatagtccctaagcaatctatttgaaagcagtagcatacctctctactcatgtactgaggcctaacagctattgaaattttgttctgtttattcatttattcattttttgagacagagtttcactctgttgcccaggctggagtgcagtggtgtgatctcacttagctcactgcaacctctgcctcccgacttcaagcaattctcctgcctcagcctcctgagtagctgggattacaggcacccacaaccacacccggccaatttttgtatttttactagagacagggtttcgccatgttggccaggctagtctcctgacctcaagtgattcacccgcctcagcctcccaaaatgctgctagtgagccaccgtgccctgcctcttttgtttatttttgagcctttctgtcctactttccactctttcacactcctacccacccacacattcaaaatcacgtcacattcttgaatctttgggtcttagggcaaactgcaatgcttaactttaatacagagtacattaatggagaaaaagatacagtgagggaagtgggagggatggagggcagtgtgatacatgtaacctcaaaaggtgctgtcacaaatatagtttctctgcaaactcttcttgtaacttaaatttgtgaatttttattttattttagaattatttttttaaaaatccaatgtttggatttacctctgaagatttttctcaagatgtgcatcatcatgcttacactgttttcaatgatctctgggtccagaagttaaggaactccaagaatgaaattgtgaaagggtgactactggcccctgctatgtactcaaaatcttatttgcagatctcctatcttgctctttgtaggttacttaaaaaaaaattattcctattcttttattcttttacctggggtctcaaaaaaagattttgttagtttttttt

SEQ ID NO: 81001 - DNA, 3103 bp, Homo sapiens
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggtaagtctgttcatttaaatgacaaatggagagaggctctctaaaaggaagtgatctgtatttgggaatagggcattgcaatgggaatgcctgtgctatagtcaactatgtacatattcagaggagtaaaggaaaacaagtttttaaggacaaatgacgaggattacaaaattactttgaggtaattattcttggctaccaagatcaataacaaggatgacaccagtccaaggttgacaggcagttgctaggcagattttctcacgagagaagttttttggtgcaaggttgcagtggcctttgtgtaaggttgtagtttttgtaaaaaggaaaaaaaaacccttaatccttgttatcagacatacaagggtgagacccttctcttcagggttgcatttttgttaacactagtgactccattttgattttgacaacttgcacatatcttagttgttgggttttttttgtttgttttttgttttgttttttttttttttttgacaatggtgacttgctctgtcacccaggctggggtgcagtggcccgatcatggctcactgcagcctcaagcagtcctcccccttcagcctccaaactgtttggattataggcaagagctacttactacacctggccatggatcttcttgtgtcaactttgagaccaaatttactgcagtgcttaaaatgttttaagaagttatacacatgtgctggatgtggtagctcacgcctgtaatcctgtagcaggacaagccgcagacaaatcccctcagacaccgagttaaagaaggaagggctttatttggctgggagctttggcaagactcacgtctccaaaaactgagctccccgagtgagcaattcctgacctttttaagggcttacaactaagggagtc

SEQ ID NO: 81002 - DNA, 1945 bp, Homo sapiens
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggtaagtttttatttgaaagcggtcttgcatagtgaggttttatgattagggaagaacggtaatatgttgattaaaatgttaaacatgatgataattttccacatttgggaatttggaggatggttagctgttaccttggtacagatataaatgaatttttctctataaagagatcttaataatggactttggacttataaacacaggagaataaggagacttataaacccagtgaattccttgtgcaagattcctggcatagcttctgctcaagtacttctgtgctgaagcacgatgcctatagcagcccattcagttagtagagagaatctgttagaattcatattgggatggtatgattccagttaccttgtctata

SEQ ID NO: 81003 - DNA, 1113 bp, Homo sapiens
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagtgagtgccagctgctgtgcaagtatctagacaagtaattcaagaattatgataggccacggggaaacaataatggtgacactgtggggaatggcttgttagagaagacaagacttgtcatgtttagctaaagaggggaaggggcctgtaaaa

SEQ ID NO: 81004 - DNA, 622 bp, Homo sapiens
ctcaagatgtgcatcatcatgcttacactgttttcaatgatctctgggtccagaagttaaggaactccaagaatgaaattgtgaaagggtgactactggcccctgctatgtactcaaaatcttatttgcagatctcctatcttgctctttgtaggttacttaaaaaaaaattattcctattcttttattcttttacctggggtctcaaaaaaagattttgttagtttttttttttcttttttggctcagaaaaaaaagattttggaatctgctatcttggaattagaccttctgattcatcttaagtgggataccttccatccttgtctgtgtataacctttcctcaggtaaagctaacttttttctctttcagatgggtttcagcccagcagaagcattatctttgccagttggagtgctggagactttggatcggttggtgccactgaatggctagaggtattctttatcatcccttcccatattggacacgagcttgtgggcttaggctgttgtccagaagtgatgtttttataggtttgattttaccacttttgcctttgcgtttagtctcagtagagtccagaattgaaaatgaatccctaatgctactgtatgtga

SEQ ID NO: 81005 - DNA, 405 bp, Homo sapiens
acaggagaataaggagacttataaacccagtgaattccttgtgcaagattcctggcatagcttctgctcaagtacttctgtgctgaagcacgatgcctatagcagcccattcagttagtagagagaatctgttagaattcatattgggataaaatcctattccccgaaacatccatttgtctggatttttcttctaagcaatacggtatgattccagttaccttgtctatagattgagaagccttgcttcttatgatggtttccagagaaaccatttatggttgtggctcgctcctctggatatcctccctgtaacgttagtgtctctctttaaaaacagagcccagttccattagagtacgtagcattaattttgatttggatgtggacatatttatcatttcc

SEQ ID NO: 81006 - DNA, 537 bp, Homo sapiens
tctgatacagtagtatctttttcaataattctctattctgatacctgaggttcttctgtgtggcagttcagaatgatggatcaagctagatcagcattctctaacttggtaagatatttcagttgtatttctgtgtctgcaagaatgtgaaatatacaagcatgactttaactgagtaagcatgaaataataaccccaatctattatcaggtattcatttacatttgattggtagtcttgaggcataactgatctcacaaagagttcagccttcagtagggttaattatggaaagtcttggaagaattctcagagtggttctgggtgtggtagacggggacagcttagtagataagacgaattaaagccctgatcaaaatgttttagtaggagaagtaaaaagcaaaggcttgcggggcgctgtggctcacgcctgtaatcccagcactttgggaggctgaggtgggtggatcacctgtggtcaggagttcaagaccagcctgaccaacatggtgaaactcggtctctactaaaaat

SEQ ID NO: 81007 - DNA, 5554 bp, Homo sapiens
  misc_feature (5551)..(5551): n is a, c, g, or t
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 81008 - DNA, 5485 bp, Homo sapiens
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaaaacggggtcctctagagtcaccg

SEQ ID NO: 81009 - DNA, 5156 bp, Homo sapiens
  misc_feature (5153)..(5153): n is a, c, g, or t
gagctcggtaccctgtctccgtttcgggacgttaagagccgaagtatttcatccccccccccgagagagcgtctgtctccgtttcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 81010 - DNA, 4982 bp, Homo sapiens
  misc_feature (4979)..(4979): n is a, c, g, or t
ttcttgtgctggcgtgtggttcttgcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 81011 - DNA, 3044 bp, Homo sapiens
  misc_feature (3041)..(3041): n is a, c, g, or t
ccaggactcgggatcagacagatggtcatgaagaaactcagtgatcggtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 81012 - DNA, 5526 bp, Homo sapiens
  misc_feature (5523)..(5523): n is a, c, g, or t
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 81013 - DNA, 5508 bp, Homo sapiens
  misc_feature (5505)..(5505): n is a, c, g, or t
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 81014 - DNA, 5504 bp, Homo sapiens
  misc_feature (5501)..(5501): n is a, c, g, or t
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatccgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtaggtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 81015 - DNA, 5457 bp, Homo sapiens
  misc_feature (5454)..(5454): n is a, c, g, or t
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacaagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtaggtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaagcggcgcgccgcttctagtagtatctcctcgtagggagacacaaggcttacgcggtacccatgctttcnttg

SEQ ID NO: 81016 - DNA, 3946 bp, Homo sapiens
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacccggcggtagcaatggtattgatgtgagctagattagagatgattttcatagggtggtagagg

SEQ ID NO: 81017 - DNA, 2245 bp, Homo sapiens
gagctcggtaccctgtctccgtttcgggacgttaagagccgaagtatttcatccccccccccgagagagcgtctgtctccgtttcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagaaggccacagatgatgctccttctcacggatgcgaggccatcaaatcactttttgtctccgctgctctctctccat

SEQ ID NO: 81018 - DNA, 2953 bp, Homo sapiens
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggtgagcactgattccaattacgtttttattttgctgaatgtcaagtattttgaaatgtgatgtgttcctgtgtgttcctgttggaagggtgattgtagccatagtacattttaaagtgaactgaggtataattgtatgtagaattggtaacttgtttgagagaagtcgggaggctgtggattagagacctaggacagagctcagcaggtgtttcagaatccagagcagtgtcaggttttctgtcactcatgtctcccaggcagcccgtcagtaggacacggaatatgaagatctcagcaaggagttgggctgtgtgcctctcgggcgtgacccggatggaaagacagcacagctagcaggattccatctcgtagtgatctgcgcatctaaaagtcaaatattctattaaacgaaactgataagcagggtgaggtggtgcatacccgtagccccagctacttctgctgaggcaggaggattgctggagtccagcccaggcaacatagcaaaatcccatctctaaataaa

SEQ ID NO: 81019 - DNA, 1727 bp, Homo sapiens
gagctcggtaccctgtctccgtttcgggacgttaagagccgaagtatttcatccccccccccgagagagcgtctgtctccgtttcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcgtcgacgcggccgcgaatttagtagtagtagtaggcgccgc

SEQ ID NO: 81020 - DNA, 890 bp, Homo sapiens
cagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggtacacggggtcggcggctgtgcgcagaggcgtccctgcgcctctcgtcccttcgcctctcgtcccttcccttctctctgccttcttgcccgcctcctcggtcacagagcgacgaatgacgagaccaggtgtacccccactgtcgctctcagccccggggacttcgggtcctcgcccttgaaggccgcaggccctagtgcgccggctccgggctgcgggtccgggagcgcgggcgcagccaaggtgcagctgcgcggcgtgcggcgccgggggaacacgtggctgctccaggaagtcgccccagggaacggctgggattcgtgggtgaccttgggctcctaaaccttcggttccccgggctccgggcgggccccgttctcactgcgg

SEQ ID NO: 81021 - DNA, 632 bp, Homo sapiens
caagaaattaaaaaattaactgggtgtggtagcccatgcctgtagtcccagctacttgggaggctgagacgggagaacctcttaagcccaggaggtaaagattgcagtgaggggtgatcgcgccactacattccagcctgggcaacattgtgagaccctgtctcaaaaacaaacaaacaaaaaaaatcatgtattgatttgattttcttatcttaaaatgtaggcaataaaacctctcttctagctttccaggtttccaaatgctttaaggtcagttaaaatttaatagtcataattggcttttgtggaaaacttcatgacctcagacttttattgtttaccttttaatgtgtttcatatgatacaggtttccttatgaatattcaaaaagatatccaaagttggcagttccagtgattttaagagtggatatagtatataaaaatggattgagaaagtgctacaaattagaaaaccctttggaatgctatagctgtgggacaattttcttaaaaataaaaaaaaagcaaaaaccccctttctcacaaatgattataaaaataggcaatattctagtgctattagtagttccatgctttcgtaaatgattgtgcatgtttttgctaactgca

SEQ ID NO: 81022 - DNA, 342 bp, Homo sapiens
gtgcccaccatgcccaattaattagaattgaccttttaattgttataaattgttcctccatattttgagtaactttttgttttaaagtctgttttgtcttaggttagaatagacacttcagctcttatggttgctgtttgtatggtttatcttttaaaatccctctactttcaacctatttgtattatcaaaaatgatgtatctgctgtaaagagcatatagttaaatcttgagtttttaattttaaaattctatctgtttttgccttgtgatgtgattatttaatctgtttgcatttaatgtcattattgatgtgattggattcacattttctggcttacg

SEQ ID NO: 81023 - DNA, 549 bp, Homo sapiens
caggctggagtgcagtggcacgatcttggctcattgcagcctcagtctcctgggcacaagcaatcctccctcctcagcctcccaagtagctggaaccataggtgtacactactacacccagctaatttttgtattttttcatagagatgaggtcttactgtgtttcccatggtagtctcaaacccctgggcttatgggacccttccacctcggccgctgggattatgagcataagccaccatgcccggcccagaatgcacttagctaaacccccaatccagtgctaatttcataagcctattgctacctaaagatcctacttcagcttagaactttagtccgccttgcttggcagaaatccagtgtaataaatcattactcactgatcattcactgggtttatcacattgcagtaagtacttggagaatcaagatatactcatatgcctcagtttgggggagaagcatggttatgctcgggaagacagattttcatgggaaccaagaatgccatgttgaaaacagatctgttactttgtcacatgcctc

SEQ ID NO: 81024 - DNA, 402 bp, Homo sapiens
ggtcatgtttccacaacatcgtgaatgagtttagtgccacagcattaaatgtattcatggtgtacttgtgtacttatgaatggctaagatgataaatattatgtacattttaccacaataaaaaagtaatgaattctggccaggtacagtggctcacccctgtaatcccagcactttgggaggctaaggcaggctgatcacttgaggtcaggaattcaagaccagcccagccaacatggcaaaaccccatctctactaaaaatatagccaggcgtggtggcgcatacctgtaatctctgctatttgggagactgaggcaggagaatcgcatgaacccgggaggtgcaggttgcagtgagccaagattgtaccactgcactccaacctgggttacagcatctc

SEQ ID NO: 81025 - DNA, 448 bp, Homo sapiens
agagcccgccccaccctgcagctccgtgtgaccccggctgtgacctcccgggtgggtggccctgccgcaggagagccactttcagagatgccctgagtgatcgtcaccagctgcatcctgcaaacttcatcttgctgtccctgtggcttggagagcccagtcagctttgcttgtaaacatacatgttacttacagttgtatttggtcatgccagatgaaattactgtttttagaggtcaaagtgagcaagtagcaactttatatggttccagctaatatttatgttacatttatgttctgatgaaacacttttgtgctactgacccatttttgtggatgactgcagaaaatatactgaaacttaatgatgacaatgaaaacctcaaacctaaatgtaaaataaaaaacatgaaaaaatggtggcagagctcaccatcttaaatgcttt

SEQ ID NO: 81026 - DNA, 348 bp, Homo sapiens
aatgatcctcccacctcagtttttgatttttttttgtagagacagggtctcgctgtgttgcccaggctggtcttgaactcctggcctcaagcagtcctcttgccttggtgtcccaaagtgctgtgattacaggtgtgagccacagtgcctggcctaaagaatttgataacgtgaaactttcccctttttaaaaaatgtaggataaattgaagtatgtgtatatatgaataatagacagaattatacgtggatagctgttccccagttgtttgcctttttcatggggaaccagtgttccaatgttactggtgtcctatgtatccttccaggaagacaatacgcttatac

SEQ ID NO: 81027 - DNA, 411 bp, Homo sapiens
agcatgtgtataaagaatgtacttttagtggacatgcttcactttgcaaatatagtgcataattttcaaatacatctttgactcttcctcaaacctgctcagaagctgtgtttttcctctcttcattaaaatgttccaacctggaaattttctctttacaattcagatatttttcacttcttgggaagggaataactaaataatttcaatactttaaactacaaggatgatgtatttttgttctacacagcattgatatggtggagctgtattctttttctaataatacaaataatatagggctgtaagggtttgtatccattgcatgtatatgttaaggaggataagaggtatgtattaaaagtaaattttgagaaattataagtataaaccaaaaagtcttataccttt

SEQ ID NO: 81028 - DNA, 6173 bp, Homo sapiens
tcaggccggcagcggggagccgagtggaggctaattttacttgctgggagcgaggagagtaatcctcctgccccccactcctgccccgccccctggctggctcagcagggcagctcagccgacagcctcagccagcctagtccccaaggcgggggcattggggacacagggaagggaaagcactggggtgggggagcaggagaaagccagattcccagggaagccatggagccatcctcaccccaggatgaaggcctgaggaagaaacagcccaagaagccagttcctgagattctgccaaggccaccccgggctttgttctgcctgaccctggagaaccccctgaggaaggcctgcatcagcattgtagaatggaagcccttcgagacgatcatcttgctcaccatctttgccaattgtgtggccctggccgtgtacctgcccatgccggaagatgacaacaactctctgaacctcggcctggagaagctggagtatttcttcctcattgtcttctcgattgaagccgccatgaagatcattgcctacggcttcttattccaccaggacgcttacctgcgcagtggctggaatgtgctggacttcaccattgtcttcctgggggtcttcaccgtgattctggaacaggttaacgtcatccaaagccacacagccccaatgagcagcaaaggagccggcttggatgtcaaggccctcagagccttccgagtgctcagacccctccggctggtgtcgggggtgcctagcctgcaggtggtcctgaactccatcttcaaggccatgctccccctctttcacatcgccctgctggtcctctttatggtcatcatctatgccatcatcgggctggagctcttcaagggcaagatgcacaagacctgctacttcattggtacagatatcgtggccacggtggagaatgaagagccatcgccctgcgccaggacgggctcagggcgccggtgcaccatcaatggcagtgagtgccggggcggctgcccagggcccaaccatggcatcacccacttcgacaacttcggcttctccatgctcaccgtgtaccagtgcattaccatggagggatggactgacgtcctttactgggtcaatgatgccatcgggaatgagtggccctggatctattttgtcaccctcattttgctgggatccttcttcatcctcaacctggtgctgggtgtcctgagtggggaattcaccaaggagcgggagaaggccaagtccaggggaaccttccagaagctccgggagaagcagcaactagatgaggaccttcggggctacatgagctggatcacgcagggcgaggtcatggatgttgaggacttcagagaaggaaaactgtctttggatgaaggtggctctgacacagagagcctgtatgaaattgcaggcttgaacaaaatcatccagttcatccgacattggaggcagtggaaccgcatctttcgctggaagtgccatgacatcgtgaagtccaaggtcttctattggctggtgattctcatcgttgccctcaacaccctgtctatcgcctcagagcaccacaaccagccgcactggctgacccgtttgcaagacattgccaaccgggtgctgctgtccctcttcaccactgagatgctgatgaagatgtacgggctgggcctgcgccagtacttcatgtctatcttcaaccgcttcgactgcttcgtggtgtgcagcggtatcctggagatcctgctggtggagtcgggcgccatgacacccctgggcatctccgtgctccgctgcatccgcctcctgaggatcttcaagatcaccaaatattggacgtcgctgagcaacctggtggcatccctgctcaactccatccgctccatcgcctccctgctgctgctgctcttcctcttcatcgtcatcttccgcctcctgggcatgcagctctttggggggaggtatgactttgaagacacagaagtacggcgcagcaactttgacaactttccccaagccctcatcagcgtcttccaggtactgacaggggaagactggacctcaatgatgtacaatgggatcatggcctcgagcgggccgtcctaccctggcatgcttgtgtgcatttacttcatcatccttttcgtctgtggcaactacatcctgctcaatgtcttcctggccattgccgtggacaacctggccgaggcggagagcctgacttctgcccagaaggccaaggctgaggagaaaaaacgcaggaagatgtccaagggtctcccagacaagtcagaagaggagaagtcaacgatggccaagaagctggagcagaaacccaagggtgagggcatccccaccactgccaagctgaaaatcgatgagtttgaatctaatgtcaatgaggtgaaggatccctacccctcagccgacttcccaggggatgacgaggaagatgagcctgagatcccgctgagcccccgaccacgtcccctggctgagctgcagctgaaagagaaggccgtgcccattccagaagccagctccttcttcatcttcagccccaccaataagatccgtgtcctgtgtcaccgcatcgtcaatgccacctggttcaccaacttcatcctgctcttcatcctgctcagcagcgctgcactggctgcggaagaccccatccgggctgattccatgagaaatcagatccttaaacactttgacatcgggttcacctctgtcttcactgtggagattgtcctcaagatgacgacctacggagccttcctgcacaagggttccttctgccgcaattacttcaacatgctggacctgctggtggtggccgtgtccctcatctccatgggacttgagtccagtgccatctccgtggtgaagatcctgagggtgctgagggtgctccgaccactcagagccatcaacagagccaaggggttgaagcacgtggctaggtgcatgttcgtggccatcagcaccatcgggaacatcgtgctggtcactaccctcctacagttcatgtttgcctgcatcggcgtccagctcttcaaggggaagttcttcaggtgcaccgacttgtccaagatgacagaggaggagtgcaggggctactactacgtgtacaaggacggggaccccatgcagatagagctgcgtcaccgcgagtgggtacacagcgacttccacttcgacaatgtgctctcagccatgatgtccctcttcacggtctccaccttcgagggatggcctcagctgctgtacaaggccatagactccaatgcggaggacgtgggtcccatctacaacaaccgtgtggagatggccatcttcttcatcatctacatcatcctcattgccttcttcatgatgaacatctttgtgggcttcgtcattgtcaccttccaggagcagggagagactgagtacaagaactgtgagctggacaagaaccagcgccaatgtgtacagtatgccctgaaggcccgcccactgaggtgctacattcccaaaaacccataccagtaccaggtgtggtacattgtcacctcctcctactttgaatacctgatgtttgccctcatcatgctcaacaccatctgcctcggcatgcagcactacaaccagtcggagcagatgaaccacatctcagacatcctcaatgtggccttcactatcatcttcaccctggagatgatcctcaagctcatggccttcaaggccaggggctactttggaaacccctggaatgtgtttgacttcctgattgtcattggcagcatcattgatgtcatcctcagtgagatcgacactttcctggcctccagcgggggactgtattgcctgggtggaggctgcgggaacgttgacccagatgagagtgcccgcatctccagcgccttcttccgcctgttccgtgtcatgaggctgatcaagctgctgagccgggcagaaggagtgcgaaccctcctgtggacgttcatcaagtccttccaggccctaccctacgtggctctgctcatcgtcatgctcttcttcatctacgctgtcatcggcatgcagatgtttgggaagatcgccttggtggatgggacccaaataaaccggaacaacaacttccagaccttcccacaagctgtgctactgctcttcaggtgtgcaacaggtgaggcctggcaggagatcctactggcctgcagctatgggaagctgtgtgacccagagtcggactatgccccaggggaggagtacacatgtggcaccaactttgcatactactacttcatcagcttctacatgctctgtgccttcctggtcatcaacctctttgtggctgtcatcatggacaattttgactacctcacccgggactggtccatcctgggccctcatcacctggatgagttcaaggccatctgggcagagtatgacccagaggctaaggggaggatcaaacacctggacgtggtgaccctgctgagaaggattcagccccctctgggctttgggaagttctgcccacatcgggtagcttgtaagcggctggtgggcatgaacatgcccctgaacagcgacggcacagtcaccttcaatgccacactctttgccctggtccgcacggcactcaagatcaagacggaaggtaactttgagcaggccaacgaggagctgagggccatcatcaagaagatctggaagagaaccagcatgaagctcttggaccaggtcatccctccaataggagatgatgaggtgacagtggggaagttctacgccacattcctcatccaggagcacttccggaagttcatgaaacgccaagaggagtattatggctatcggcccaagaaggacattgtacagatccaggcagggctgcggaccattgaggaagaggcagcccccgagatctgtcgcacggtctcaggagacctggctgctgaggaggagctggagagagccatggtggaggctgcgatggaggaggggatattccggaggactggaggcctgtttggccaggtggacaacttcctggaaaggaccaactccctgccccctgtcatggccaatcagagacccctccagtttgctgagatagagatggaagagatggagtcacctgtcttcttggaggacttcccacaagatccacgcaccaaccccctggctcgtgccaataccaacaatgccaacgccaatgtcgcctatgcgaacagcaaccatagcaacagccatgtgttttccagtgtccactatgaaagggagttcccagaagagacagagacgcctgctaccagaggacgagcccttggccaaccctgcaggtccctgggaccccacagcaaaccctgtgtggagatgctgaagggactgctgacccagagggcaatgcccagaggccaggcacctcctgccccctgccagtgccccagggtggagtcctccatgcctgaggacagaaagagctccacaccagggtctcttcatgaggagacaccccacagcaggagcaccagggagaatacttccaggtgctcagcaccagctacagccctgctgatccaaaaggctctggttcgagggggcctgggcaccttggcagctgatgcaaacttcatcatggcaacaggccaggccctggcagatgcctgccaaatggaaccagaggaagtggagatcatggcaacagagctactgaaaggacgagaggccccagagggcatggccagctccctgggatgcctgaacctcgggtcctccctgggcagcctcgaccaacaccagggctcccaggagacccttattcctccaaggctgtgatgcccacacagcatcagcatgggcttagagctggcatgaccaatgggggtggggaagttgctggggtggagaagggctagcccaccgcagcagcctccctccctctcagcagctagatgcatggcctgaggcagggtggtcaggaaccacctcaaaaagtgcggaggaagtagctggacaggccctgcccctcaccagcaagaggcatgattggatggagcttctaatgtcattcaaaaaggcctggtcagtgcctgtctggcctagggccactcccacctgcaggacattaaaatctccaggcctgtgacactggcaaaaaacct

SEQ ID NO: 81029 - DNA, 3049 bp, Homo sapiens
gctgctgctactactaccagccttgctccagcccccaccccatgcagatagagctgcgtcaccgcgagtgggtacacagcgacttccacttcgacaatgtgctctcagccatgatgtccctcttcacggtctccaccttcgagggatggcctcagctgctgtacaaggccatagactccaatgcggaggacgtgggtcccatctacaacaaccgtgtggagatggccatcttcttcatcatctacatcatcctcattgccttcttcatgatgaacatctttgtgggcttcgtcattgtcaccttccaggagcagggagagactgagtacaagaactgtgagctggacaagaaccagcgccaatgtgtacagtatgccctgaaggcccgcccactgaggtgctacattcccaaaaacccataccagtaccaggtgtggtacattgtcacctcctcctactttgaatacctgatgtttgccctcatcatgctcaacaccatctgcctcggcatgcagcactacaaccagtcggagcagatgaaccacatctcagacatcctcaatgtggccttcactatcatcttcaccctggagatgatcctcaagctcatggccttcaaggccaggggctactttggaaacccctggaatgtgtttgacttcctgattgtcattggcagcatcattgatgtcatcctcagtgagatcgacactttcctggcctccagcgggggactgtattgcctgggtggaggctgcgggaacgttgacccagatgagagtgcccgcatctccagcgccttcttccgcctgttccgtgtcatgaggctgatcaagctgctgagccgggcagaaggagtgcgaaccctcctgtggacgttcatcaagtccttccaggccctaccctacgtggctctgctcatcgtcatgctcttcttcatctacgctgtcatcggcatgcagatgtttgggaagatcgccttggtggatgggacccaaataaaccggaacaacaacttccagaccttcccacaagctgtgctactgctcttcaggtgtgcaacaggtgaggcctggcaggagatcctactggcctgcagctatgggaagctgtgtgacccagagtcggactatgccccaggggaggagtacacatgtggcaccaactttgcatactactacttcatcagcttctacatgctctgtgccttcctggtcatcaacctctttgtggctgtcatcatggacaattttgactacctcacccgggactggtccatcctgggccctcatcacctggatgagttcaaggccatctgggcagagtatgacccagaggctaaggggaggatcaaacacctggacgtggtgaccctgctgagaaggattcagccccctctgggctttgggaagttctgcccacatcgggtagcttgtaagcggctggtgggcatgaacatgcccctgaacagcgacggcacagtcaccttcaatgccacactctttgccctggtccgcacggcactcaagatcaagacggaaggtaactttgagcaggccaacgaggagctgagggccatcatcaagaagatctggaagagaaccagcatgaagctcttggaccaggtcatccctccaataggagatgatgaggtgacagtggggaagttctacgccacattcctcatccaggagcacttccggaagttcatgaaacgccaagaggagtattatggctatcggcccaagaaggacattgtacagatccaggcagggctgcggaccattgaggaagaggcagcccccgagatctgtcgcacggtctcaggagacctggctgctgaggaggagctggagagagccatggtggaggctgcgatggaggaggggatattccggaggactggaggcctgtttggccaggtggacaacttcctggaaaggaccaactccctgccccctgtcatggccaatcagagacccctccagtttgctgagatagagatggaagagatggagtcacctgtcttcttggaggacttcccacaagatccacgcaccaaccccctggctcgtgccaataccaacaatgccaacgccaatgtcgcctatgcgaacagcaaccatagcaacagccatgtgttttccagtgtccactatgaaagggagttcccagaagagacagagacgcctgctaccagaggacgagcccttggccaaccctgcaggtccctgggaccccacagcaaaccctgtgtggagatgctgaagggactgctgacccagagggcaatgcccagaggccaggcacctcctgccccctgccagtgccccagggtggagtcctccatgcctgaggacagaaagagctccacaccagggtctcttcatgaggagacaccccacagcaggagcaccagggagaatacttccaggtgctcagcaccagctacagccctgctgatccaaaaggctctggttcgagggggcctgggcaccttggcagctgatgcaaacttcatcatggcaacaggccaggccctggcagatgcctgccaaatggaaccagaggaagtggagatcatggcaacagagctactgaaaggacgagaggccccagagggcatggccagctccctgggatgcctgaacctcgggtcctccctgggcagcctcgaccaacaccagggctcccaggagacccttattcctccaaggctgtgatgcccacacagcatcagcatgggcttagagctggcatgaccaatgggggtggggaagttgctggggtggagaagggctagcccaccgcagcagcctccctccctctcagcagctagatgcatggcctgaggcagggtggtcaggaaccacctcaaaaagtgcggaggaagtagctggacaggccctgcccctcaccagcaagaggcatgattggatggagcttctaatgtcattcaaaaaggcctggtcagtgcctgtctggcctagggccactcccacctgcaggacattaaaatctccaggcctgtgacactggcaaaaaacct

SEQ ID NO: 81030 - DNA, 311 bp, Homo sapiens
aaaaacacattaccatttacatttacattagcatccaaaaatgtgaaacaggtataaatctaacaaaatatgtaaagatctatatgaggaaaactacaaaatgcaggaaaaatataaaagaagaactaaataaaaggatagatatttcatgttgatgaacaggaacactcaatattgtaaaggtatcagtttttccaaatttgacctacgaagtcagtgctatcccaaacaaaatcccagtaagttattttgtagggattgacaaactgattttaaagtttacatagagaggcaaaaatcccagaataatc

SEQ ID NO: 81031 - DNA, 695 bp, Homo sapiens
agaccgtggctccctgaatggcagagaagagtttgtagtgctgcgccggcagaacttgctggaaacctcctctccagaatttgccagatatcctctttctaagacagcagggggcgcttttcaaggggcaggtcgagggaagttgctggccccgcggctgctgctgtgcatggcagggaacctggttcccgggctgccgctcacactgttcaagtcgagcactgggagctgcatgcactgctaagagaagacgctagaaccgacaaagacccttcttcctgcactgtctccccagtacactccattgacaagccagctaccaaaggaaaaagaaaagcgggtacctttcaaaatagctagaaaaaaataattcgaatgttcctagcataaagaaaagatgaatatttaaggtgatggatatctcaattactctgatttgatttttacacatcacatgaatgtatcaaattaacacatgtacccccaaaatatgcacatctattatgtatcaacaaaaaaaatcaacaaaaaagaaagcagggaatgaagagtaaatttggagaggagaggcaacacctttgtaactggaacagagagtatcctgcaagcagttctaaatggatgcggccagctgcttccgggtgatggtgagcataagaagaacccttttctgcactcctctctcagtggaatgt

SEQ ID NO: 81032 - DNA, 376 bp, Homo sapiens
cgcctgtagaatgagggaacttcactttaatactgggagagaagcgatcacaacgaggaaacgaggtttgcaaaaataagtaatttcagaagagaaggaaaccagcagattagttttgtctgcgtccgtcacgtctgagtaaactaagaaatctgaaggtagatgtgggagtggtgtttataatttcccttacgtaagcacggctagaacggaggcgacgggcactggaatttagaactcagcatttgaaaacactttgtttccgtgccataaaagagcgccaaaatggggctacaacggctaaagaatttccaaaaagttccttgtgcaaaataaaggagtcgggggcgcagtgatcggaggctttccgtccttt

SEQ ID NO: 81033 - DNA, 403 bp, Homo sapiens
agttactaaatattgacatttaatgtttggcaggagcttgcacaaacatgagaagaaagatggtataattaatacataggatttgtttcctgatgagcttctgcatcagttgtgttggaagggaaaggaatttatgtcaggaaatagccttaaaggttttgctatcctgaaaacactgagattttcttgtcttcacttgtttctttgtttttattgatatgagacttcaggactttgaagtacttagcatcaacactaagaatcatcatttcttagtgataaatgctaattattagaaattggcctttgataaattgctgaacaaacaacttttaagtattctacttcaaaggctatactaattgcctaattttggccattcttaggcaatcattactgtatg

SEQ ID NO: 81034 - DNA, 568 bp, Homo sapiens
ctcttgggtaaagatgatgcccaattcaacattctgaattgcatctagcaattgttattgctcaataaatatcgtagttgtaatgcttggagggctgggatgctgtggcttagacaaaacttttgccaatgtgtggaaatcagctcacactgccattatatttctagctgactcgcaagtgttgagcctgggttgggctgctcatcatgtgatactttcatagcttcacttctcaggacagttcagctaacatgggtctcagagccctgtttcagctgcagcttcttctttgtggtttatatgcagtttttgtaatctgcagtaatgagctaaggatctgaatgctaggaaacaaaggagtagtataagaaaactattagacttaagaaaaccatattagagttctcaaacttccacatcctgttttccatttattcattaaagaatatgggccgggcgcggtggctcacacctgtaatcccagcgctttgggaggccgaggcgggcggatcatgaggtcacgagatcgagaccatcctggctaacacggtgaaaccccgtctctact

SEQ ID NO: 81035 - DNA, 126 bp, Homo sapiens
tgcattttgctcttttgtcattgtttcaaagtcaagttgatggccacaaaattccagaggctaagcaatgcagaagtttcatctactggcagctagttttatttcttaaaaatacattaaattaga

SEQ ID NO: 81036 - DNA, 484 bp, Homo sapiens
tatgttgcccagggtcacacactaagtggcacagccaggattcaggtccagttggagctcctataagctggactagacagtcttataatgaacaatggtgacgataacaatagctaacattgacaagcgtttaatgcgttccagacaccggactgagacagaaaagccattatctcttgctcagtgatgatccttagaggcaggcactattattattttatccccatttcacagacaagcaaacggaggcccaggaagataaggtctacgcagccagtcaggagtgagcctcccagatccgtctggtacagttctgcacaagagacactacagatgctctatcagggaggggtgtgtgtgtgtgtgtgtgtgtgtgtgtgtgtgtgtgtgtttcccctctggggagactctagatgtgagtgaagtgcagccagtctagatgtcagctcagaaggccctgaatgaagccccaaccgtgagggga

SEQ ID NO: 81037 - DNA, 780 bp, Homo sapiens
ctttttcattcttgttacttgtgatgcaattaagtgaagataagaaaaaaaaaaaaaagcagagatttaccatgtatcagtgcctggctttttgttattaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaagaaaaaaagggaaaacatttcaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgaaaaaa

SEQ ID NO: 81038 - DNA, 334 bp, Homo sapiens
ttagacctggcccgtgcactcgtttgccacagtctccaccatgccctgttactccccgacactgcacctaggggccaggtccgtttagcacagcacttccatctgtgttcctcacaccctgctgcttcccctcaccgacttcacacctgtcctgccccagaggaagttaatttggtgatggcctatgtgaagacagtcagtaggtggttcccgcctggaatcccagcactttgggaggccaagacgggaggatcacttgagcccacgggtttaagaccagcctgggcaacatggcaaaaccctgtctctataaaaaatacaaaacattagccag

SEQ ID NO: 81039 - DNA, 406 bp, Homo sapiens
gtggtaatggtggtggaggtggtggtggtgatggtggtggtggtggttattgtggtggagatggtggtggtgatggtggaggaggtggtggtggtgatggtggcagtggcagtggtgatagtgatggaggtgacaatggtcattgtggtggtggttgttgtggtaatggtggtggaggtggtgatggtgatggtagtggtggagtggtgatggtgatggtagtggtggcagtggtgatagtgatagaggtggtgatggtgatggtggcagtggcagtggtgatagtgatggaggtggcaatagtcattgtgatgatggtggtggtggtaatggtggtggaggtggtgatggtgatggtagtggtggcagtggtgatagtgatggaggtgatgatggtcatggtggt

SEQ ID NO: 81040 - DNA, 805 bp, Homo sapiens
tcctgaagagcacaaaatgcaggtcaggccatgtcctgcagccctggctaagctcaggggtcaatcagttccagaagccaacagctaccccaggccttggaagagagaaaggaaagttctaattcaatacatcccaaacccatctctggatgtgccgcttcatatctagacctcctctggggtcccctaactcagagaaaaggctctgtcacccaccactcatgctgtcaggaccccgggcaccaacaccacccgccccacagcccacctggcgccaggtgccgctgcctcctcggctgcacatccccgccgtacacttgtctccccatcggctcctcccgcccatgggaccttcgaagacactgctgcctctgcctgaagtactttaccttccccccttacctgacattcaataactgcttagtgcccttaaaagagctgcactctcaggagcagagttttgtgagcatagcaggcttccaactgacccctggttcctccctcatcctccgtaacccacccgccacctgcagtcagagtgaccacctaaaacccactgcttgcacctgccgtggcgtccagggccctcaaagtcctgcctcatgcctgcagcccacaacaccctaccctacccactggctggacagcccatgccagaccgcttccctctccacaccagactccaaccgcccaccccaccctacctcctcttctagaaaacaccaggctcacatcccgctcagaacctcagccacggccactggggagggtccagccagtgccttccccgggtaggggcagctcc

SEQ ID NO: 81041 - DNA, 1563 bp, Homo sapiens
aacggtaacttgctttttatgtttgtgtttttaatttatgcccaatacatgctttactgactcagaggaacaattcctggacatataattgggtaatgcaaatttttatccactggtcatgatttgtcttaaaatgtttacttgcctccctaaaatattttggctgtgtaggtttggtgtttgtcctagaggattcttcaacagaaagtgatttattctttactgttttgtgaggtaatatggtttagaacatatgtataagctaaaaacagtattttactcagatcagtagttatcgtgtctatcagctataaaaaaaatcaactgccagccaagaactttaaaactttaagctgtgtattatagaaccgttttgtgtagcattggaatattgtccattttgtaagtcattgtgaatgttcttaattatcagcttgaaggtatttttgtattaaaagttgacattgaagaacctaagtggatgatgggatttggggccagtagtgaaagtatgtttcctctaaaatatttccctaaacagtggtatacatggttattttattatgagatttgtatatgttctgtgtttctctgtgaacaatgtttcagtctctctgtcaccatatgtaaggggaagtccacaaatatagactacattgcacaaaactaaaattgttaattacaagaaaatataggtgcttaccttttgaaggtttattaatacatatggttgtcacaatacgtatatatgataaatggtgtacatatacagatgtttatggtgtataaatttttctatacccaattagaattatcttcctgattctttattcaataacatgctaattcctcttctatgttctatagtgacagaatgctaacttttcttataccctggcagaggacagaggagtctggtctaggatggggaactgaatttttgaacgaaaaggaaagagaaaggatgaaaaaacaaacaaacaaaaaaacacacgataatgtttcttagtcattttgattggccatttgaacagtctacaagtttaacgttatttccagtgaagtaggatggctgacctagcaatacatgtttcttcaaaagggtaaacatgctttagtgacctaaagctaaattttgtacatttgacatcagggatgttataagtactgcacttaatacaaagctatttctcaattgtgttatttttgagacaaatttttcttcaccattaacttcttgttggtagctttttgttttgtaaaaattgagagatggcaatgcttatctcaaccagattatccatctgcagaattaaggtatgcaactggtaaataaaagacaaatgctccagtttgtctttctcaacctttgagttcttaacctttgagttaaaacctagtctaaatagtgggaatgtcttggtttacagtaaggttttcttgggaaggatcttggttttgtgatctatttgtgaattaaggagtagatgttaaccattattttatagataagtgatttgtacatggttagttataaataaaactggtactagaacccaggtt

SEQ ID NO: 81042 - DNA, 804 bp, Homo sapiens
aacggtaacttgctttttatgtttgtgtttttaatttatgcccaatacatgctttactgactcagaggaacaattcctggacatataattgggtaatgcaaatttttatccactggtcatgatttgtcttaaaatgtttacttgcctccctaaaatattttggctgtgtaggtttggtgtttgtcctagaggattcttcaacagaaagtgatttattctttactgttttgtgaggtaatatggtttagaacatatgtataagctaaaaacagtattttactcagatcagtagttatcgtgtctatcagctataaaaaaaatcaactgccagccaagaactttaaaactttaagctgtgtattatagaaccgttttgtgtagcattggaatattgtccattttgtaagtcattgtgaatgttcttaattatcagcttgaaggtatttttgtattaaaagttgacattgaagaacctaagtggatgatgggatttggggccagtagtgaaagtatgtttcctctaaaatatttccctaaacagtggtatacatggttattttattatgagatttgtatatgttctgtgtttctctgtgaacaatgtttcagtctctctgtcaccatatgtaaggggaagtccacaaatatagactacattgcacaaaactaaaattgttaattacaagaaaatataggtgcttaccttttgaaggtttattaatacatatggttgtcacaatacgtatatatgataaatggtgtacatatacagatgtttatggtgtataaatttttctataccca

SEQ ID NO: 81043 - DNA, 426 bp, Homo sapiens
aatttctttttattattccgtactttttaaatttacttcattatcacgtcttcctttattctttttaaatagtttttgcttttgttattttgttttcccttttttactcttggtttgtaatacctctttccttatttgctcctttctcatttgatctcaatgttaatccaactgttttccacatctgattcactaaaattttagcccttaaaaaaaaaattcctgtttttcctatctccttttgcccattctcttctccttgcctcacttcttttatctttttccattttactttcattttttgtttctctagatgttgttttgacatatgagttaatgtactggtacaattttgcatctgtaaattagagcttcagaatcaactgagtgtatttattctttatttttaggcctcaatttatctta

SEQ ID NO: 81044 - DNA, 805 bp, Homo sapiens
gcacacaggatgttacactatattcatttgagtttcttgatgtttcacttaacaaaagccagattaatttagctttagtagaaaagaaaaacgttgttgtaacggtactaccgggttcttcataacctcaaccagcatcgaaagttaagggaaacaagaactagaaagacattgagaactccagcagtacctccattcagtctctgatttctgctttcttcagggcttctgctttattcttctttcccatgagttgctttctttaatgctctatttccttgttacagtttgtctgactagtgttgctaagttttctttatcatagttctagccacaagtagagatctctctctctgtcctacctccaagttctgtggagagataatctagttggttccacttagatcaaagggtccaaccctgatgtcatcagtggtggctagaaggaggtggtgcagggtgatgacaatgaaggtggctgtggctgtgggtgatagggtggagtcatccaggacacctctgcctccccagggctcactcctttggatgggggttaggtaggtaggtgtgtgggcgggtgatggtatttcccagagaatggagggtaccaccagagcttggataaactggtaccttataagatacataggattaaaaaagactaatacatattgagggtgtaagaaaaataaggtcaattaaataatgatgtaaaagataagcatacagcccatgatccagcttggtttaatgtttcctaatatttaaagcaaaagttgaagtattacttattctgtgatcctgt

SEQ ID NO: 81045 - DNA, 500 bp, Homo sapiens
aagctgtcatcagttggaggtaagcggaagacagtagagagtacagagccctggactgtgactcagaggatgagcaccagatccagtttgctgtgccacagtgctcagcatgatgtaaactccactgcggacagatgcagccaagaagacaggtcaccttctaccaactcccaccagaggaaactcttccccaggacccagtacgttggccctctgaccctgcacacagcacatgatgctgaggttcagtgctgaacaagagctactgagagccagagactcacttcttccatggagccccactcatggatggaggctctgtcccgggtccagtgccactgggaacactgggtctctggtttctagctctgtcctatggcagaggttccaccccacaataaccgaagtgctgagaaggtgggaagctcctgcccgaccctccactgagagctcagctcctaggctgaggaataaaacagctcaactttgtctacacctgc

SEQ ID NO: 81046 - DNA, 440 bp, Homo sapiens
aagctgtcatcagttggaggtaagcggaagacagtagagagtacagagccctggactgtgactcagaggatgagcaccagatccagtttgctgtgccacagtgtgctccctttatggcagtacaattgaagagggacccacagtcttgctgaaggaacatgaccttcctactgaagttgggattacggaatagagggagaagaggaaagatggatgtttatctgaatggtcggatcttgttttccagaggacacaggccaatgggaaacttttgggaaggaagtcaaaaaatcaaagccagaactgggttttggtaatttaatctcccaaagagagaaaagtccccatactctaattcatattttgtttgacttgactgaagcccttttgaatattttttctgcttctgttctgttcttgcaataacaatgacataagtt

SEQ ID NO: 81047 - DNA, 107 bp, Homo sapiens
cccccgacttcccgccccgccccgccccggagccgggtccggagtgcctggtgggctgattccggagcgtggaagggagcacggagcacggaagcgagagggaggcg

SEQ ID NO: 81048 - DNA, 600 bp, Homo sapiens
aggatccccccccaaatgatccacttgagattataacatgcgttcttgacttatcaatgtctaatgtaaattagtattttttcctcttcccagacaatgctaaaacagtttattggatattttagttatttctgtatttaaaacttcacaagacacagtactgttgatgttcattttgatggcccacatatatgccactatcattgtgttttatccttctgtgactttctagggtcatttcccttccacctgaagtacccctactattatttcctttagaggaggtctgctgatcatctcagttgtgtttgtctgaaaatatttgtatttaatttttattcttaaaaaatattttttctgagtatggaattctaggttgtcagctcgtttctttcaacacattaatgatgtaactccactgttatgtgcatccatattttctgctgttttttgaaataaatattttcctctgactgcgtttaagtgtttctctgtcttcaattttcttcaattttactatagtttatctggatgtatatgcctttttattcgtcttattgggaattgattagacttactgagtgtctggattgttgtatg

SEQ ID NO: 81049 - DNA, 948 bp, Homo sapiens
gggaggccagggtgggtgggttgcttgagctcaggagttcatgaccagcctgggcgacatggcaaaaccccatctctatcaaaaatacaaaaaaacggccaggtatggtgacgtgtgtctgtggtcccagctactcaggaggctgaggggagaggatcacttgagcctgggaggttgctgtgagctgagattgtatcactgaactccagcctgggtgacagagtgagactgtctcaaaaaagctttatatatatttttatatatatgagtattttatatatacactatattacatatatttatgtataaagctatgtatatttgcatatatatagctgatttatacatattaaatagcttttagtggtacacttgagattataacatgcgttcttgacttatcaatgtctaatgtaaattagtattttttcctcttcccagacaatgctaaaacagtttattggatattttagttatttctgtatttaaaacttcacaagacacagtactgttgatgttcattttgatggcccacatatatgccactatcattgtgttttatccttctgtgactttctagggtcatttcccttccacctgaagtacccctactattatttcctttagaggaggtctgctgatcatctcagttgtgtttgtctgaaaatatttgtatttaatttttattcttaaaaaatattttttctgagtatggaattctaggttgtcagctcgtttctttcaacacattaatgatgtaactccactgttatgtgcatccatattttctgctgttttttgaaataaatattttcctctgactgcgtttaagtgtttctctgtcttcaattttcttcaattttactatagtttatctggatgtatatgcctttttattcgtcttattgggaattgattagacttactgagtgtctggattgttgtatg

SEQ ID NO: 81050 - DNA, 588 bp, Homo sapiens
acgacaatttcagaatctatcgtcactatctggacctagtcattagacataatgtaaattagtattttttcctcttcccagacaatgctaaaacagtttattggatattttagttatttctgtatttaaaacttcacaagacacagtactgttgatgttcattttgatggcccacatatatgccactatcattgtgttttatccttctgtgactttctagggtcatttcccttccacctgaagtacccctactattatttcctttagaggaggtctgctgatcatctcagttgtgtttgtctgaaaatatttgtatttaatttttattcttaaaaaatattttttctgagtatggaattctaggttgtcagctcgtttctttcaacacattaatgatgtaactccactgttatgtgcatccatattttctgctgttttttgaaataaatattttcctctgactgcgtttaagtgtttctctgtcttcaattttcttcaattttactatagtttatctggatgtatatgcctttttattcgtcttattgggaattgattagacttactgagtgtctggattgttgtatg

SEQ ID NO: 81051 - DNA, 319 bp, Homo sapiens
gaatttggatccaaagtttggacattgcatttcattaatacgtcccttaagtttattttaatctgtattttcctcctcccttttgtgttctttgtaatctctttttgctgttgttttcggttaaagaaaccatgtttttttcgtcctgtgagtggctcctgttcagaattttactgatttcatctgctggtatcatttagcatgttgctctgtccgccgtagtactttaaactagacgttagatctagagatgtgatctacttcggtaggactttgtcaagaatacttgtaagtagtatttaggtaccaggagacacat

SEQ ID NO: 81052 - DNA, 470 bp, Homo sapiens
  misc_feature (3)..(5): n is a, c, g, or t
ggnnngagggaaaggtcatagtcctgtttggcggccatttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtgggggattttttttatatatatttctagacaataaagatttgtttgtttttcaa

SEQ ID NO: 81053 - DNA, 414 bp, Homo sapiens
cttccgaggtcttgcgttgcttctcctgctcatccaacgctgagatctgatccggaagctgctgatcaccagtttcagctgttttctatctgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtgggggattttttttatatatatttctagacaataaagatttgtttgtttttcaa

SEQ ID NO: 81054 - DNA, 632 bp, Homo sapiens
aatactttacagttagacttcagaagtctttgaaattgttaaacttgtcaaaggtaagttttcaaatgttttggaactggccaaaagatttttctagtgttgatgtttaattttctagctcttagctataatcttttgcagtggcaaccttttgcagtggcctttgttgcgggaacttagttttgaattttagttgggtctggctgttttgttatattgattttctgtactagcttcaaagctccaaattctggtaattatttcctttggaaaatcataaagatgtcattttataacaaccatatggtggaaaataagtgccatgtgcttttcaacaaatctatgtgaaacttttttttaaaatgaatatatttaaaaaatttttttaaagacaagaatattataaatatagtattcagtattttcataataaaaatatagtaattcatatcatacatggtttctggttggaacaacaaaatcgactttttctatttacaggtgtaataatgtcctttatatcagaggtgtggaagaagaggaagaagatggggaaatgagagaatagcatcttttgtgggggattttttttatatatatttctagacaataaagatttgtttgtttttcaa

SEQ ID NO: 81055 - DNA, 459 bp, Homo sapiens
ttaaaaaaaaaacaaaaaaaaaaattgttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtgggggattttttttatatatatttctagacaataaagatttgtttgtttttcaa

SEQ ID NO: 81056 - DNA, 638 bp, Homo sapiens
ttaaaaaaaaaacaaaaaaaaaaattgttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtgggggattttttttatatatatttctagacaataaagatttgtttgtttttcaaaaaaaaaaaaaaaaaaaaaaactcgagtttttttttttttttttttttttcatcttcattatcctctcacaggaccaacttttattttatttattcatttaaggacaaatttttaaaagtaaagtgaatgaaaccatttgtgattaagatacatagacagaacttcaatgtagaaaaaa

SEQ ID NO: 81057 - DNA, 456 bp, Homo sapiens
  misc_feature (440)..(440): n is a, c, g, or t
ttaaaaaaaaaacaaaaaaaaaaattgttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtgggggattttttttaaaaaaaacaaatctttattntctagaaatatatata

SEQ ID NO: 81058 - DNA, 569 bp, Homo sapiens
ttaaaaaaaaaacaaaaaaaaaaattgttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagattttcatctacatcttgggaatattgaaacaaagtaagattctgctcttccagctctctgaggacttgaagtaactcctctggttccttgaaataaagtgctggctcctaattaatcaataatgaagaatataatttacttaaaaatatgctacctatgcacatgtgacttatctagaaaatacagtggggtaaaggaagacagttctaaggatgagggagacacaggtaggaacttgtatgggaaactcgcctatttccaagtgagagctggctttcagaaagagcacatttgcagtgttgtgg

SEQ ID NO: 81059 - DNA, 908 bp, Homo sapiens
  misc_feature (3)..(5): n is a, c, g, or t
  misc_feature (848)..(848): n is a, c, g, or t
ggnnngagggaaaggtcatagtcctgtttggcggccatttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtgggggattttttttatatatatttctagacaataaagatttgtttgtttttcaacttgacttgtgaactatttgtattcagatatttacaagcaaagctgaaatgatgaaccaattgggaaagattactcactgaactaatgctttaaaagccactgaatttcatttaagttgcttttcttttgtaagcccaatattcttttttttcccataaaggataattatttatatgctttagatatttttatgaaggtgaatttcagaccttttcttgtaaaattatctattagctgagaccttttaaatgcaactttttcttttaaagttatttttgagctacttttaacgtataaaattaaacattttcttggtattaataatatactgtcttattttacttagtagtcaataaattacatgttacttctgtggncacaaacaaaaacaccactaaaaaaaaaaactaaacacaaacacaacaacacaaaccaca

SEQ ID NO: 81060 - DNA, 334 bp, Homo sapiens
ggctaggtacgaggccgggtggtgccaacccaaactttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtgggggattttttttatatatatttctagacaataaagatttgtttgtttttcaa

SEQ ID NO: 81061 - DNA, 756 bp, Homo sapiens
ttaaaaaaaaaacaaaaaaaaaaattgttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtgggggattttttttatatatatttctagacaataaagatttgtttgtttttcaaaaaaaaaaaaaaaaaaaaaaacaaaaaaacctaaatcactaaactttatttacataactctttatatactacactttatatcacaataaaaatattccttattttctcctcataacaaaatactcttggggggggcgcctttccaaattcccctttagggtggcctcttacataatggggccttcttttaaaccccctttatgtgaatacccggcgttccccaatttaaaccctgtggaaaaaatctcctttccaacggtgcatttattcaaaaggcccccaaccttagggttttaa

SEQ ID NO: 81062 - DNA, 496 bp, Homo sapiens
  misc_feature (480)..(480): n is a, c, g, or t
ttaaaaaaaaaacaaaaaaaaaaattgttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagcttgcaaatacagaagaatacatagatggagctttgtctggacatctgggtgaagttttaataaggtgtaataatgtcctttatatcagaggtgtggaagaagaggaagaagatggggaaatgagagaatagcatcttttgtgggggattttttttatatatatttctagacaataaagatttgtttgtttttcaaaaaaaaaacaaatctttattntctagaaatatatata

SEQ ID NO: 81063 - DNA, 844 bp, Homo sapiens
ttaaaaaaaaaacaaaaaaaaaaattgttctcttgaaactgcggctcgggacctgcggtacctgctgtagtcacgagggacgggcggcggcctggtcggcagagagtagcctgcaacattcggccgtggttacgatgagtttacccctcaatcccaaacctttcctcaatggactaacaggaaagccagtgatggtgaaacttaagtggggaatggagtacaagggctatctggtatctgtagatggctacatgaacatgcagattttcatctacatcttgggaatattgaaacaaaatggagtttcactctcgtcgcccaggctggagtgcaatggcatgatctcggctcattgcaacctctgtctcccaggttcaagcgattctcctgcctcagcctcccgagtagctgggattacagctaggacctccagaacactgacaaaaagaagtggtgcagtggaaatccttgccttgttcctaatcttagggggaaagcattcagtcttttaccattagatatgtaatgttagtgataagtttctagtagatgtccttttataaagttgaggaacttctcttctgttcctactttgctgagagtctccatcaagaatgaattttggatattgttgagtggtttttctgcatcaattgggataatcatatgggttttcatttttaatttgttaatgtgtattacattgatttatttttaaatgttaaattacttttgtattcttagattaaaccctaatttgtcataatgtattatctttttagtattattggatttggtttgttacattttgttcagaatgtttgcatatttgcttacgagagat

SEQ ID NO: 81064 - DNA, 3282 bp, Homo sapiens
tcgattacgtacggactccttggttattcgtgccgaggatttgtggcccgctatggcggcggtgttgaggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81065 - DNA, 3324 bp, Homo sapiens
cacacacacaacaacaacaacaaacaaacaagcacataacgtactacgtacagagaccggcctgttaattccgcacgcaggtttgtggcccgctatggcggcggtgttgaggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81066 - DNA, 3440 bp, Homo sapiens
tcgattacgtacggactccttggttattcgtgccgaggatttgtggcccgctatggcggcggtgttgaggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtagtcacagcctccccagggacgctgcgcgcggagccctgtcagagcagcgcgtcagtgacagcggcagccgagccaggaagttatcaggcagcctcgaccaccaccagatttgactccgcgagctcttttgagggaaaacctggtaaaacgtcaaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81067 - DNA, 2527 bp, Homo sapiens
tcgattacgtacggactccttggttattcgtgccgaggatttgtggcccgctatggcggcggtgttgaggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaacccgggctcctttgtcggggggggacaggggtcttgcatggccctggcctagtgttccggccgttctgtccag

SEQ ID NO: 81068 - DNA, 3244 bp, Homo sapiens
gtacccgggagtatgtcgacccgcgacgtcggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81069 - DNA, 4876 bp, Homo sapiens
gagaactggtgaagggagggccgcggaatcagatcatgtctggatctgatggctccgtgctgtgctcaagcgtgctgtgccttcacaccatggtttatattgaatgtgtcgcctgagttgtcaggcttgcttttccaaagtgtcacttgtgttatttatcattaaagtttggtaagcaatgaagtctgagctctttgtacagttttcctatcattctgtacatgatttgagttaggtcttccaaaactggtggggagcaaacgccgcacatgtacatgtataatatttttaataataatctacatttgtaagttaaggaggtttacatcaaaatccaattaattttgaaatttaatgaaatgcagtaacttgactaccttggaattttgggcctttttcctgtaaatgtcttttttggtctacattaatatttttggttcccattacaaaagtcagcattaaaaaaataagcagacttttgtttgtttctctacatttgtttttgaaaccctaaacctgagtgttttaagtaaagttcactaactcattcatttattatctgacagttacacgttgacagcatcctcattgaatcctttatgttaaaagcatagcagaaagtgctcccattacttatttggccaaactactgtttggtccatgcaagagaaacatggaagtgtcttcatgtatgttatttccttgagggtataaagttcagaaggaaatattgataccatatcttctaatagttttgctctgttcccagtgaacctccttaaactgcatgtatatgtcactgttccaatgtatgtgtgtctctctatcacgtaacccagcacttatttcctcagccaagtggctagggggcgagcctagccaagattttacctccaatggacgcaagtttctttggtgaagatctctcctgagagttcgggactagcagaaagaagcgaggaaatttcgaccgtttggttcttacggataggtatttatgtatttggtttgtgtgaatgtaagctatgatatttaacttttcagaaaaaaataataattttttgcaagtggcattgaatggttgaccaaaccataatggtaagaactgccagtgaagtgggtaccatttttgctattaatggattgtttgcctttagttataaatgttatcttactgtggaaaggaatttagagtttgttaagataacttgagtttaaaagtaggtgagatatgactatccaaattaaatataaatctgggaagagtttttatacttgttttaatatttttgtttattttaatcggtaagtatgtgtgtgtatatatatatacatatataaaacatcacacacgcacaccagtctagacgttaatttccttttattgaccagcttgttcacattacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaaggtactgctcaagacaaacttacttcagcaacaaactttttaaaatttttaagtatttaaaaatttactcccattcatttttttatactcactctttctgatattatcttgacagtacccagtggattggaaaaacaggagtctttgcgttctgagaggacctcaggatagtttatatatagagccacaaagaattttcccagcttttgagggcagactgggatttgaaaaaaacaaaaaccaaactctttaactgttcttctttaacagtatcgtataaataaaattgatgttcttgtctttgccgtaacagtctttaatacagttcttaatcccaaaattttctcagcaggaagaaattttccacaaaagacgtgtattcagctgtctgtgggtaaacatgtactgacaaaagtacataatgatagatataaagtgtgaatttttaaaactattttacctcaaaagtaggttgaaaaaagtatgttgtatgctttactgatagctacaactttagaaatatataaagtttttctcagtaattttctatttttgttgataaaattctcatttttattcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81070 - DNA, 4463 bp, Homo sapiens
gcagaggacctttttgcgggccttcccccattacaaaagtcagcattaaaaaaataagcagacttttgtttgtttctctacatttgtttttgaaaccctaaacctgagtgttttaagtaaagttcactaactcattcatttattatctgacagttacacgttgacagcatcctcattgaatcctttatgttaaaagcatagcagaaagtgctcccattacttatttggccaaactactgtttggtccatgcaagagaaacatggaagtgtcttcatgtatgttatttccttgagggtataaagttcagaaggaaatattgataccatatcttctaatagttttgctctgttcccagtgaacctccttaaactgcatgtatatgtcactgttccaatgtatgtgtgtctctctatcacgtaacccagcacttatttcctcagccaagtggctagggggcgagcctagccaagattttacctccaatggacgcaagtttctttggtgaagatctctcctgagagttcgggactagcagaaagaagcgaggaaatttcgaccgtttggttcttacggataggtatttatgtatttggtttgtgtgaatgtaagctatgatatttaacttttcagaaaaaaataataattttttgcaagtggcattgaatggttgaccaaaccataatggtaagaactgccagtgaagtgggtaccatttttgctattaatggattgtttgcctttagttataaatgttatcttactgtggaaaggaatttagagtttgttaagataacttgagtttaaaagtaggtgagatatgactatccaaattaaatataaatctgggaagagtttttatacttgttttaatatttttgtttattttaatcggtaagtatgtgtgtgtatatatatatacatatataaaacatcacacacgcacaccagtctagacgttaatttccttttattgaccagcttgttcacattacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaaggtactgctcaagacaaacttacttcagcaacaaactttttaaaatttttaagtatttaaaaatttactcccattcatttttttatactcactctttctgatattatcttgacagtacccagtggattggaaaaacaggagtctttgcgttctgagaggacctcaggatagtttatatatagagccacaaagaattttcccagcttttgagggcagactgggatttgaaaaaaacaaaaaccaaactctttaactgttcttctttaacagtatcgtataaataaaattgatgttcttgtctttgccgtaacagtctttaatacagttcttaatcccaaaattttctcagcaggaagaaattttccacaaaagacgtgtattcagctgtctgtgggtaaacatgtactgacaaaagtacataatgatagatataaagtgtgaatttttaaaactattttacctcaaaagtaggttgaaaaaagtatgttgtatgctttactgatagctacaactttagaaatatataaagtttttctcagtaattttctatttttgttgataaaattctcatttttattcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81071 - DNA, 3553 bp, Homo sapiens
cagctcggtacccttccaccagcaaagactgcacaccagtctagacgttaatttccttttattgaccagcttgttcacattacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaaggtactgctcaagacaaacttacttcagcaacaaactttttaaaatttttaagtatttaaaaatttactcccattcatttttttatactcactctttctgatattatcttgacagtacccagtggattggaaaaacaggagtctttgcgttctgagaggacctcaggatagtttatatatagagccacaaagaattttcccagcttttgagggcagactgggatttgaaaaaaacaaaaaccaaactctttaactgttcttctttaacagtatcgtataaataaaattgatgttcttgtctttgccgtaacagtctttaatacagttcttaatcccaaaattttctcagcaggaagaaattttccacaaaagacgtgtattcagctgtctgtgggtaaacatgtactgacaaaagtacataatgatagatataaagtgtgaatttttaaaactattttacctcaaaagtaggttgaaaaaagtatgttgtatgctttactgatagctacaactttagaaatatataaagtttttctcagtaattttctatttttgttgataaaattctcatttttattcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81072 - DNA, 4248 bp, Homo sapiens
gagaactggtgaagggagggccgcggaatcagatcatgtctggatctgatggctccgtgctgtgctcaagcgtgctgtgccttcacaccatggtttatattgaatgtgtcgcctgagttgtcaggcttgcttttccaaagtgtcacttgtgttatttatcattaaagtttggtaagcaatgaagtctgagctctttgtacagttttcctatcattctgtacatgatttgagttaggtcttccaaaactggtggggagcaaacgccgcacatgtacatgtataatatttttaataataatctacatttgtaagttaaggaggtttacatcaaaatccaattaattttgaaatttaatgaaatgcagtaacttgactaccttggaattttgggcctttttcctgtaaatgtcttttttggtctacattaatatttttggttcccattacaaaagtcagcattaaaaaaataagcagacttttgtttgtttctctacatttgtttttgaaaccctaaacctgagtgttttaagtaaagttcactaactcattcatttattatctgacagttacacgttgacagcatcctcattgaatcctttatgttaaaagcatagcagaaagtgctcccattacttatttggccaaactactgtttggtccatgcaagagaaacatggaagtgtcttcatgtatgttatttccttgagggtataaagttcagaaggaaatattgataccatatcttctaatagttttgctctgttcccagtgaacctccttaaactgcatgtatatgtcactgttccaatgtatgtgtgtctctctatcacgtaacccagcacttatttcctcagccaagtggctagggggcgagcctagccaagattttacctccaatggacgcaagtttctttggtgaagatctctcctgagagttcgggactagcagaaagaagcgaggaaatttcgaccgtttggttcttacggataggtatttatgtatttggtttgtgtgaatgtaagctatgatatttaacttttcagaaaaaaataataattttttgcaagtggcattgaatggttgaccaaaccataatggtaagaactgccagtgaagtgggtaccatttttgctattaatggattgtttgcctttagttataaatgttatcttactgtggaaaggaatttagagtttgttaagataacttgagtttaaaagtaggtgagatatgactatccaaattaaatataaatctgggaagagtttttatacttgttttaatatttttgtttattttaatcggtaagtatgtgtgtgtatatatatatacatatataaaacatcacacacgcacaccagtctagacgttaatttccttttattgaccagcttgttcacattacagatatgatggacgtggtcacctgcatgacctttctgagtacgatgctgagtattccacgtggaacagagattatcagctgtctgaagaggaggcgcgaatagaggccctgtgtgatgaagagagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81073 - DNA, 3225 bp, Homo sapiens
tggtcactagctgactctagagggtacaacgatgattagagatcccagtggattggaaaaacaggagtctttgcgttctgagaggacctcaggatagtttatatatagagccacaaagaattttcccagcttttgagggcagactgggatttgaaaaaaacaaaaaccaaactctttaactgttcttctttaacagtatcgtataaataaaattgatgttcttgtctttgccgtaacagtctttaatacagttcttaatcccaaaattttctcagcaggaagaaattttccacaaaagacgtgtattcagctgtctgtgggtaaacatgtactgacaaaagtacataatgatagatataaagtgtgaatttttaaaactattttacctcaaaagtaggttgaaaaaagtatgttgtatgctttactgatagctacaactttagaaatatataaagtttttctcagtaattttctatttttgttgataaaattctcatttttattcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81074 - DNA, 3277 bp, Homo sapiens
cacacacacaacaacaacaacaaacaaacaagcacataacgtactacgtacagagaccggcctgttaattccgcacgcaggtttgtggcccgctatggcggcggtgttgaggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81075 - DNA, 3013 bp, Homo sapiens
gtacccgggagtatgtcgacccgcgacgtcggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81076 - DNA, 3191 bp, Homo sapiens
aggtattgggatattgtcgacccaggctgtcgagtggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81077 - DNA, 2391 bp, Homo sapiens
gtacccgggagtatgtcgacccgcgacgtcggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaattgggggcaatttatgcggggggggggaaaaaggggttaagaaagtgggccaatgggcgcaataggcgggttcccgggagccacaagtctctctggtgtgcaaacaaggggggagaacatctgcgcgggggtcccgccaataaagggagaggccggaaataacttcgcgagaaaagcccaggggtaacccggggattaaaggacgg

SEQ ID NO: 81078 - DNA, 2551 bp, Homo sapiens
gactcttgacgtctaatgagccttaactcttggtccccaatgtgtcttgcagccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81079 - DNA, 2483 bp, Homo sapiens
gtacccgggagtatgtcgacccgcgacgtcggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaaggtttgttgatagcttttaaacttcttgaaagaaaggaaatacacaaatataagatttatctgctaagccaaaaaatctcgaggctgccaactagaatctgaagcctttggaaatcgacctatttgggagttgtgtaacatgtctgaggttttgaaacgttctcttttagaggaatgagctctgctcttcactgagcctcaaatgcagtgccgctggcagtttgttttcgaagaaactgagttggccgtcttagctctaatgcgccacagtggaatgcattaatggcagctcactttgcacttggctggcagccccagggtaaaaggctcagctgtcttcccagctcaggaaccaaactaggagatgccctcttgtgaggctgcctacccacag

SEQ ID NO: 81080 - DNA, 1861 bp, Homo sapiens
gtacccgggagtatgtcgacccgcgacgtcggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagttcaaacacgtcccccacagaagacgggcgagccgcagtgggtcgaccaagaggcccagaactgtacagagcacggagcggcagagccactaaaccaccggggaaatcgcagcaagggaaaggaccacataaccagcggggagaccgcccacgtaagcaaaagtacgaccgcaacgataaaggcgagacactctaactcagagcccgaaccgcaccaacaca

SEQ ID NO: 81081 - DNA, 1139 bp, Homo sapiens
  misc_feature (1094)..(1094): n is a, c, g, or t
gtacccgggagtatgtcgacccgcgacgtcggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaagntagtggaccccgatcatccccacgcagttttatccagcaaccaga

SEQ ID NO: 81082 - DNA, 1237 bp, Homo sapiens
tcctgagctttcccgggcagcagctgcgaggcgatcttccagcttttgctttgctatcaccagcttcccgtccgcgacggtcttactggacgatgcctccttcttcccgcctgagcctgcccgtgctcccacctcggctgcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81083 - DNA, 584 bp, Homo sapiens
cacacacacaacaacaacaacaaacaaacaagcacataacgtactacgtacagagaccggcctgttaattccgcacgcaggtttgtggcccgctatggcggcggtgttgaggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacaggtcggttcctctccccacccgtcgatccttcccttccctcacccgcttgatctcgtctgatgttgacttgactgcaaggactgcagagagttttctggagccagcggggatctgggggacaccccctcccctgtccccacctcctcc

SEQ ID NO: 81084 - DNA, 2204 bp, Homo sapiens
gtacccgggagtatgtcgacccgcgacgtcggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaaggtttgttgatagcttttaaacttcttgaaagaaaggaaatacacaaatataagatttatctgctaagccaaaaaatctcgcaacttgggatcctctagaacactcagcgcacct

SEQ ID NO: 81085 - DNA, 2644 bp, Homo sapiens
cacacacacaacaacaacaacaaacaaacaagcacataacgtactacgtacagagaccggcctgttaattccgcacgcaggtttgtggcccgctatggcggcggtgttgaggttgggtccgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaaaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccaccaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81086 - DNA, 1206 bp, Homo sapiens
ccaaaaaagggcacgttataaactaattctctcaaaatttgatttgtccaatcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 81087 - DNA, 604 bp, Homo sapiens
gggcggggcatacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactgaatacagttgagttttgccaaatttgacagttcacgcaagccccaccacaatcaagatatgggccgggaatggtgactcatgcctataatcccagcaccttgggaggacaacgtgggaggattgcttgagcccaggagttcaagacaagcctaagcaacataatgggacttcgtctctcaaaaaaaaaaaaaaaaaagccataataaaagtaataataatagctgggtgtggtggtgtgtgtctatagttttagctactcaggaggctggggtgggaggaagactgcttgagcccaggaggtcaaggctgcagcaagctgtgattgtaccgctgcactccaactccagcctgtgtgatagagcgagaccctgtctcaaaaaaa

SEQ ID NO: 81088 - DNA, 445 bp, Homo sapiens
tgagggatctgctaccatgacccaaacacctctcataggccccattttcaacactgctgcactgaaaacgtttacttttggtgaggacaaatgacaccgaaattatagcaactcctagtgttgaacaacagaaatatcttcctccatctcaacagctactttcccttcacactttcttatcaatcccagcttcttttatgagatctggtatgtcctgtatgtcctgtgaaattaggttggtaacaggatcttttttttttttttatgttttttaggaatttcaaataaatgagcaggtccttgcttgctggtctgattgtcgtttttacccggccaaagtcactgctgttaacaaggatggtaaggcatttgagttgtagttgtttttactcatgacttaggtggtggggggggatgtttgtaatatcagagcttgatagtatat

SEQ ID NO: 81089 - DNA, 5881 bp, Homo sapiens
gggcggggcatacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcaaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatgtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacagaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagttacgta

SEQ ID NO: 81090 - DNA, 4410 bp, Homo sapiens
gggcggggcatacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcaaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatgtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagca

SEQ ID NO: 81091 - DNA, 5855 bp, Homo sapiens
gggcggggcatacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatgaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcaaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatgtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagttacgta

SEQ ID NO: 81092 - DNA, 6032 bp, Homo sapiens
gggcggggcatacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactgagtgtttcagtggtaatgccgtgtgtttcatattgcatcacatcgggggacacataaagctaggtcgtcccactgttccgtgtatcacttggataaggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcaaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatgtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagttacgta

SEQ ID NO: 81093 - DNA, 5632 bp, Homo sapiens
cagaatcacctggaggagttgttaaaaatgcacattcctgtgccctgttcccagttgctgtttcagtgtatctgaggtgggactggtaacttgcatttctaatgagttcccaggagttgctcatgctgctgctgtgggaccacactttgagaagcactggtttactctgaggcaggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcaaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatgtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagttacgta

SEQ ID NO: 81094 - DNA, 5236 bp, Homo sapiens
  misc_feature (302)..(302): n is a, c, g, or t
cctctcgaaccttactagcagcagaacgatgaggacgctgcggagcacccggagagataagctagacacgatgagatcgtgaacgtagttgacctaagaagatcctgccttttgagtcaggtagctatgcgatcctacaccaaattgataacgcaccgaaggttaaatccgtagtctgcttgagaagcgggatcgcgtgattcggagtatctagatcgttccttaactaggcatacaatcgaacagcgaggtcacaacctgtatgcctgcagaatatgcacagtatgaacgtcactcctggnatgatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcaaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatgtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagttacgta

SEQ ID NO: 81095 - DNA, 1852 bp, Homo sapiens
  misc_feature (1675)..(1675): n is a, c, g, or t
  misc_feature (1694)..(1694): n is a, c, g, or t
  misc_feature (1751)..(1751): n is a, c, g, or t
  misc_feature (1834)..(1834): n is a, c, g, or t
gggcggggcatacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacgagcactccctgggagtgctcgtctttggtggagtccgaatcaggctgtgaacaggaagagggcagggtgagcacccgctgcctagcctggggaggcacgcctgcccagctggatgcaaatgtttgctcanggacaactgtcgcaactgntcttctccctttatggtatgaaaacccacacgctttacaccagcgaatcgtgggggnccttaagccgtgctggtgaaaatcccaaaatggaggctaatccccttcaaaataacctggaattttcattccaaagacgaccntcctggggacctttaaag

SEQ ID NO: 81096 - DNA, 1429 bp, Homo sapiens
  misc_feature (772)..(772): n is a, c, g, or t
gggcggggcatacgctgggcgcgtcccgggggtcacgtggtgcagagcacgcagagtccttctgtcggttggtcctggagcggcgcagccggagtggggccgtgagatcttattcagggcttctcagcctgaacccccaaccagattaatttctccacagctggaattccaagtgcttggggataatgatacctctgacctttcttccttttgggaagtacttgagtgtgcagctgcatgaggcctcagcaggagagagattttaggtccaagaagctataccagtaggacaaggcaggaaaatactacactttcaggatcaagcccctctgactctcatttggaaactggatgtttgctaagcacctgcttcttaaggatgccgagggatttaatgatactcccagaaacctggagagattaatggggcctatggagaagtgctctgaactcagtgttgggacttgaataaaattaaccattgtcatgttttcagaacaactaagctgttttatatttcatgtgcatgaaagccctagaactaagttgtgttatttccagaaatgaaatagatcccacagttagatgatgtggccattaggaagtaccaaatttataaaaatcactggaggtctgtctgagcagtacctaataaaatatagtatactgaaagtgaaaaaaaaaaaaaaaaaaagatgtcccgttccatttctggtctctcagctcccctttcacctcggccagatggtcattattcattgatgacatattncacagtgcacaaggggcccatagtttgcattaaggtttgctgctggtgttgtattgtttatggattttgacaaatgtataatgtatatgtgtatgttacacatttatcaaaatccatatgtgtacattatacatttgtcaaaatccataaaagttacaaaagtacaaaaaaagtacaatattcataaaaagacaacttgatgctcaaaaagtttcggattttggatgtttggatttgagatgctcaacccatagtaaaattcgctctttttcagaatacagttgagttttgccaaatttgacagttcacgcaagccccaccacaatcaagatatgggccgggaatggtgactcatgcctataatcccagcaccttgggaggacaacgtgggaggattgcttgagcccaggagttcaagacaagcctaagcaacataatgggacttcgtctctcaaaaaaaaaaaaaaaaaagccataataaaagtaataataatagctgggtgtggtggtgtgtgtctatagttttagctactcaggaggctggggtgggaggaagactgcttgagcccaggaggtcaaggctgcagcaagctgtgattgtaccgctgcactccaactccagcctgtgtgatagagcgagaccctgtctcaaaaaaa

SEQ ID NO: 81097 - DNA, 654 bp, Homo sapiens
gggcggggcatacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcaggtgagaaatgtggttttgtgctttgtgttatgaataatgctaacattgtagttttgtttcctcaaataaagacattacatttgtttatgatagcaa

SEQ ID NO: 81098 - DNA, 513 bp, Homo sapiens
gggcggggcatacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgtgagtaacaaatctgggaagttctgtagtatgcaaggtcagccattgggctgtttgtgtttcaatctttgatgttagtagcagctggagaccagttcttatttaggcctatagttgtaa

SEQ ID NO: 81099 - DNA, 272 bp, Homo sapiens
gagaactactcccatcagaatgccaagaagatcgtggccacccaccagcttcttggtgatgtgcagagagtgattgaggttctgcatggcctgcagctcaagatgagcatcttgcagtaagtgtggcacctgcagtgctgggagcagtctgtttggcatggtctgggggctgagtaaatctgagaaattggaaagctaccaaagcaatcaaatcataaaactgagtttgagacctttactaaaaattatcagtttcaggataaacattcttt

SEQ ID NO: 81100 - DNA, 5935 bp, Homo sapiens
gggcggggcatacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcaaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatgtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagttacgta

SEQ ID NO: 81101 - DNA, 5873 bp, Homo sapiens
gggcggggcatacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcaaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatgtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagttacgta

SEQ ID NO: 81102 - DNA, 5908 bp, Homo sapiens
gggcggggcatacgctgggcgcgtcccgggggtcacgtggtgcagagcacgcagagtccttctgtcggttggtcctggagcggcgcagccggagtggggccgtgagttgcttaaaactatccagttccccttccgggaggcaaaccgggttacttgatcctccttcccgaggtagcccacgcatttaaaaacaggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcaaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatgtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagttacgta

SEQ ID NO: 81103 - DNA, 5480 bp, Homo sapiens
aaacaggaacccagacctttgttgtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcaaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatgtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagttacgta

SEQ ID NO: 81104 - DNA, 1484 bp, Homo sapiens
gggcggggcatacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaaggttcatatttagagttaaattaatcctctttttatatacacttttgcttatgctttgtgaacta

SEQ ID NO: 81105 - DNA, 1498 bp, Homo sapiens
gggcggggcatacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactgcatccagctcaccatcagcacagcaccattgcactcacgcaggcaaggcaaaagtcactcatcccatttcaagcgatggacacccatcggttcatgcatgcagtcggttctgcctgggcaccagtaccttcattttcacgcccgtttcagcagcacaacatcaccagcatgcagagcacacagcaggggcttgcaatgcaaagcaggcatggcatcgtatcctgcacatattccgacacatacacacatagccaggcaagagtcccatatggcctttgcattggttctagcaatagtcagatatataaatcaccccagaggagccaaacaggtccacttgctaggtaaccaacccaagggcatcggatcaccatttcaccaactatggtggcacaaatctgtagtcatggccatggggcaagttcactttcccaaggcacgatgggtccgaacacaccaaatctaatatccaatggttcacacaacagacgttctgtataccacaacagcatcgcaagcaacataatttaggtagcgagactcacattgcatcaggagcgcctataaaaagcaaagacgaaggcaaatccaagcacacaacaggttccttacccaattccaatcgttcaccgtggcaattaacagacggcaagccagccaacagttcttccacacaagcacccgagcgagcaaacacggcccaaacgaggtggcaaaatgttgccacagccacaaggcacccaaagcaacagccatcaacaccacacccgtagtaaaccagcaagccaggaagaaacaggacggagccacaacagggccaggcacctggcattccaacgccaaccggcgcacacggtgacaacatacagggtacctggcaccacaggcggggaacaacggtggcacacgcacagacacacaggacttcgcacccacagacaacagacagcacagggcacgggacaacacggggacacacaaacaatgttcagccagggcaaacaatggacaacaggaaaaagaacaatacagtgagaagacaaattgcaacccaaacaagtcgacgtccacgaccaaacccatgacacacacgtgaacactatgcggacagaacggtcccaaccacagcagacaccatgcaagggagacacacacaaaaagacaacacgagagcgagaacaaccacacatgcaccaacagcacaccaaacagagaggggcatccacaccagcaccacacaacaagcaaacaccacacaagtgcacacgaggaaccac

SEQ ID NO: 81106 - DNA, 1186 bp, Homo sapiens
attggacggctgggcccaagtgggcggaaaacggacggtgcagggggtgggccacgtgtccagccctaacgaaacggtaaccagccctgggaagcccgcaagaggcctcagcggtggccgtccgagcgccgagaggtgagggtgcccccgcctcacctgcagaggggccgttccgggctcgaacccggcaccttccggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaaggtggcccggctgcttgaggtgccagtcatgctgacggagcagtacccacaaggcctgggccccacggtgcccgagctggggactgagggccttcggccgctggccaagacctgcttcagcatggtgcctgccctgcagcaggagctggacagtcggccccagctgcgctctgtgctgctctgtggcattgaggcacaggcctgcatcttggacccccgttcttatccggggttggccctgacctctctctacccacagaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgccccttgtgggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggc

SEQ ID NO: 81107 - DNA, 928 bp, Homo sapiens
attggacggctgggcccaagtgggcggaaaacggacggtgcagggggtgggccacgtgtccagccctaacgaaacggtaaccagccctgggaagcccgcaagaggcctcagcggtggccgtccgagcgccgagaggtgagggtgcccccgcctcacctgcagaggggccgttccgggctcgaacccggcaccttccggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaagaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgccccttgtgggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggc

SEQ ID NO: 81108 - DNA, 405 bp, Homo sapiens
aggcccagcagactgctgggccttggaagaggcccagcagtccgctgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgccccttgtgggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggc

SEQ ID NO: 81109 - DNA, 554 bp, Homo sapiens
aggcccagcagactgctgggccttggaagaggcccagcagtccgctgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgccccttgtgggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggcaaaaaaaaaaaaaacaacaacacacaaaaaaaacaccgagggcccacaaagccggggtgggcggaaaaagcgggctccgaaaggtgcacggtgggcaaaacgggccccgggcaccaacacatcctggcacaagggggcacaacccggcg

SEQ ID NO: 81110 - DNA, 1138 bp, Homo sapiens
attggacggctgggcccaagtgggcggaaaacggacggtgcagggggtgggccacgtgtccagccctaacgaaacggtaaccagccctgggaagcccgcaagaggcctcagcggtggccgtccgagcgccgagaggtgagggtgcccccgcctcacctgcagaggggccgttccgggctcgaacccggcaccttccggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaaggtggcccggctgcttgaggtgccagtcatgctgacggagcagtacccacaaggcctgggccccacggtgcccgagctggggactgagggccttcggccgctggccaagacctgcttcagcatggtgcctgccctgcagcaggagctggacagtcggccccagctgcgctctgtgctgctctgtggcattgaggcacaggcctgcatcttgaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgccccttgtgggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggc

SEQ ID NO: 81111 - DNA, 1259 bp, Homo sapiens
attggacggctgggcccaagtgggcggaaaacggacggtgcagggggtgggccacgtgtccagccctaacgaaacggtaaccagccctgggaagcccgcaagaggcctcagcggtggccgtccgagcgccgagaggtgagggtgcccccgcctcacctgcagaggggccgttccgggctcgaacccggcaccttccgggaaaacgggatcgcacgctccgtggtctttgtgttgagatctatccaggttgtggcctgtgcagggtcccccttctttcctatggctgaagaatatggcctcagtttcctcttggagcaggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaaggtggcccggctgcttgaggtgccagtcatgctgacggagcagtacccacaaggcctgggccccacggtgcccgagctggggactgagggccttcggccgctggccaagacctgcttcagcatggtgcctgccctgcagcaggagctggacagtcggccccagctgcgctctgtgctgctctgtggcattgaggcacaggcctgcatcttgaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgccccttgtgggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggc

SEQ ID NO: 81112 - DNA, 1443 bp, Homo sapiens
attggacggctgggcccaagtgggcggaaaacggacggtgcagggggtgggccacgtgtccagccctaacgaaacggtaaccagccctgggaagcccgcaagaggcctcagcggtggccgtccgagcgccgagaggtgagggtgcccccgcctcacctgcagaggggccgttccgggctcgaacccggcaccttccggaaaatggcggctgccaggcccagcctgggccgagtcctcccaggatcctctgtcctgttcctgtgtgacatgcaggagaagttccgccacaacatcgcctacttcccacagatcgtctcagtggctgcccgcatgctcaaggtggcccggctgcttgaggtgccagtcatgctgacggagcagtacccacaaggcctgggccccacggtgcccgagctggggactgagggccttcggccgctggccaagacctgcttcagcatggtgcctgccctgcagcaggagctggacagtcggccccagctgcgctctgtgctgctctgtggcattgaggcacaggcctgcatcttggtgagatgctgactgaccccaggggtccctcgttctaacctgggacccccatcctaaatagaacctccttccctgaccagaaacctccacttccctgcaggacccccatcctgacctgggccctctctcctcacctgtgggccccatcctatcttggatcccctcctgacctgggggccccttcctctgatccgagcctccctcctccccattctgggcccctaattctgactcaccatccccaattccttacccaggacccccgttcttatccggggttggccctgacctctctctacccacagaacacgaccctggacctcctagaccgggggctgcaggtccatgtggtggtggacgcctgctcctcacgcagccaggtggaccggctggtggctctggcccgcatgagacagagtggtgccttcctctccaccagcgaagggctcattctgcagcttgtgggcgatgccgtccacccccagttcaaggagatccagaaactcatcaaggagcccgccccagacagcggactgctgggcctcttccaaggccagaactccctcctccactgaactccaaccctgccttgagggaagaccaccctcctgtcacccggacctcagtggaagcccgttccccccatccctggatcccaagagtggtgcgatccaccaggagtgccgccccttgtgggggggggcagggtgctgccttcccattggacagctgctcccggaaatgcaaatgagactcctggaaactgggtgggaattggctgagccaagatggaggcggggctcggccccgggccacttcacggggcgggaaggggaggggaagaagagtctcagactgtgggacacggactcgcagaataaacatatatgtggc

SEQ ID NO: 81113 - DNA, 335 bp, Homo sapiens
tgctgtcgctcccaccctccgtgcacctagcaggagtgccagccacagccggaacagccaggccatgacccaggggagccaggctgccaccccacccagcgctgccagggagccgccatccgagcttgagctgggcgcacagaggtgcccgccaggatctgtggccctgtaacattccctcgatcttgtcttcccgttcctccccgcagtggttttgaaatcacagacctcgtgtatataaaatatgcagaacttgttttccgttcccctgccagttttatatttttggttttacaagaaaaaacattaaaaactggaaaggagatgtgaagtcc

SEQ ID NO: 81114 - DNA, 2827 bp, Homo sapiens
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctgggattacaggcatgagcaactgcgcccagccaaattctacttcttaaaaatcacaaaaactagtttaaattgatgacttgttcgtatgttcaaaatgtaacaacaaaaaaagctaacaccagtcatttatattaactttttttttttaaatcaaaaattgttaatgttagaaacatactatgaagtgcctttatctgcttagacctaaggaagattttaaagttgggttgcacaggaaatgatgatgcttcaatttcttaatagttaaaaagtgctaaatactacttgaaattattgtttacagattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttat

SEQ ID NO: 81115 - DNA, 633 bp, Homo sapiens
ttccatcagccacatggtctcatgacctgcttccctgccctgggctggccctggagcaaggagccctcatccattccacatccttcacagcgggcccttctcttcctgtggccctgagataccaacctctcacctccctccctcctcccagcacgctgcccccgtctcgtaagagcgaacttgtagttgaagttaagtcagataagctcccagaagagatgggcctcctgcagggcagcagcggtgacaagagggctccgggagaccaggtaggaggcggttcctgtggccagagcctgccacatcctcagggaccgggggcagtagggactaacggttctctctatccttcatccctctttgtcagagatagggagcaggccccatcttgccttcttaacactactcacagatggcagggccaagcaagtggctgagggagcttggaggaagactgagaaagaccctgtcccatcaccttttcctgaccaatgcccgtggctctgggtgtggccatttcaccagtgcagtcagacgggggccgccctccttccctggcctgccatgcccatcctagcttcctccccaacgctgcccaccaaattcatcggcttctgcttccatctctccttc

SEQ ID NO: 81116 - DNA, 3213 bp, Homo sapiens
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaa

SEQ ID NO: 81117 - DNA, 3173 bp, Homo sapiens
  misc_feature (109)..(109): n is a, c, g, or t
  misc_feature (113)..(113): n is a, c, g, or t
  misc_feature (165)..(165): n is a, c, g, or t
  misc_feature (231)..(231): n is a, c, g, or t
cggcacgagctcccagaagagatgggcctcctgcagggcagcagcggtgacaagagggctccgggagaccagggagagaaatacatcgatctgaggcattagccccgantcanttcagctcccttccctgcctggaccattcccagctccctgctcactcttctntcagccaaagcctccaaagggactagagagaagcctcctgctcccctcgcctgcacaccccctttnagagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaa

SEQ ID NO: 81118 - DNA, 2405 bp, Homo sapiens
ggttgtctcttcctctgccttcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaa

SEQ ID NO: 81119 - DNA, 2079 bp, Homo sapiens
cgctctgaggatccccgaacgggtgatgcggttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctgggtgagggctgcatccctgcaggggatggcaggggcaggcccaggcacgggcagtaacttgcgcttctcctaacacccctccctctgcctcctagtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaa

SEQ ID NO: 81120 - DNA, 1694 bp, Homo sapiens
  misc_feature (48)..(48): n is a, c, g, or t
gggcgctcagggaagcaggagatcacgctgcccccgtctcgtaagacntggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaa

SEQ ID NO: 81121 - DNA, 3343 bp, Homo sapiens
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatacagacaaagatgaggtctacactgtccttcatggggattaaagctatggttatattagcaccaaacttctacaaaccaagctcagggccccaaccctagaagggcccaaatgagagaatggtacttagggatgg

SEQ ID NO: 81122 - DNA, 3121 bp, Homo sapiens
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacacagcgaaggtgggtaggtaacctaagaagtaacagagacacttcagagcaggcggttccaacgctaacaccaaagacagaaag

SEQ ID NO: 81123 - DNA, 1037 bp, Homo sapiens
  misc_feature (55)..(55): n is a, c, g, or t
ttataaaaggcaagttccgtcaggcgtcaggaaaccagagtcacggctacccccngtttcgtaaaacgaacttgtagaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaa

SEQ ID NO: 81124 - DNA, 2678 bp, Homo sapiens
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccgggattacaggtgtgagccgcatgcccggcgggcttttaacttttaattgtcctaatgttaaggtcaacttgtgggtgttaagaacagtga

SEQ ID NO: 81125 - DNA, 2734 bp, Homo sapiens
  misc_feature (2381)..(2381): n is a, c, g, or t
  misc_feature (2413)..(2413): n is a, c, g, or t
  misc_feature (2497)..(2497): n is a, c, g, or t
  misc_feature (2509)..(2510): n is a, c, g, or t
  misc_feature (2516)..(2516): n is a, c, g, or t
  misc_feature (2534)..(2534): n is a, c, g, or t
  misc_feature (2540)..(2540): n is a, c, g, or t
  misc_feature (2548)..(2548): n is a, c, g, or t
  misc_feature (2550)..(2550): n is a, c, g, or t
  misc_feature (2556)..(2556): n is a, c, g, or t
  misc_feature (2568)..(2568): n is a, c, g, or t
  misc_feature (2576)..(2576): n is a, c, g, or t
  misc_feature (2583)..(2583): n is a, c, g, or t
  misc_feature (2596)..(2596): n is a, c, g, or t
  misc_feature (2605)..(2607): n is a, c, g, or t
  misc_feature (2614)..(2614): n is a, c, g, or t
  misc_feature (2626)..(2626): n is a, c, g, or t
  misc_feature (2661)..(2661): n is a, c, g, or t
  misc_feature (2733)..(2733): n is a, c, g, or t
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccgataaaaagnatgagccaccgcgcccggccactcttcggatnttaagcctgtgctaatggcgtgtccgctggccgtgtgggagtggaaggttctcttgggcagttagccgtcacagtgagtggganagaagaataggnnaagacnacgaagaataaggatatnccattnagactagntnaaggangcaggaagaganaaaaaagnaaaaacnatatctgagaagnaattaaagnnnaaaaggnaagataatcttnaaagccatcatttcgacctgaggtcccctgaaagntctgaagagatcgtgcaagtcgcctcctggaaagatgacagagccctgggtgtgtgctgggaccgaagcggng

SEQ ID NO: 81126 - DNA, 2207 bp, Homo sapiens
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagcaggccccatcttgccttcttaacactactcacagatggcagggccaagcaagtggctgagggagcttggaggaagactgagaaagaccctgtcccatcaccttttcctgaccaatgcccgtggctctgggtgtggccatttcaccagtgcagtcagacgggggccgccctccttccctggcctgccatgcccatcctagcttcctccccaacgctgcccaccaaattcatcggcttctgcttccatctctccttc

SEQ ID NO: 81127 - DNA, 435 bp, Homo sapiens
  misc_feature (24)..(24): n is a, c, g, or t
  misc_feature (66)..(66): n is a, c, g, or t
  misc_feature (154)..(154): n is a, c, g, or t
  misc_feature (156)..(158): n is a, c, g, or t
  misc_feature (162)..(162): n is a, c, g, or t
  misc_feature (178)..(178): n is a, c, g, or t
tgagatttagccttcaaatccccnccgttgtttctactttggcctcctcattagcccttctttgantgtgattctatcgttataatacttgaaatggcagctggggatgtctagttcttaatgattgttggttctttcttcttttccttttttngnnntttntttttttttttttttntcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaa

SEQ ID NO: 81128 - DNA, 748 bp, Homo sapiens
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgtgagtagccctttctcccaaaagccacccttgggccaggtgtggtagctcacacctgtaatctcggtgctttgggaggccaaggcaggaggatctctggaggtgaggagttcaggaccaccttggacaacatagggtgaccctgtctctaca

SEQ ID NO: 81129 - DNA, 3331 bp, Homo sapiens
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaa

SEQ ID NO: 81130 - DNA, 3593 bp, Homo sapiens
  misc_feature (3462)..(3462): n is a, c, g, or t
  misc_feature (3473)..(3473): n is a, c, g, or t
  misc_feature (3491)..(3492): n is a, c, g, or t
  misc_feature (3516)..(3517): n is a, c, g, or t
  misc_feature (3521)..(3522): n is a, c, g, or t
  misc_feature (3565)..(3565): n is a, c, g, or t
  misc_feature (3579)..(3580): n is a, c, g, or t
  misc_feature (3586)..(3587): n is a, c, g, or t
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaaatcatacattgcttttttattcaacatgggtaccacaggaacctgggggcctgtgaaactacaaccaaaaggcacacaaaaccgtttccagttggcagcagagatcaggggttacctctgcttctgagcanatggctcaagntctaccagagcagacagnnaccctacttttcagcagcaaaacnncccnnatgacgcagcacgaagggcctggcaggctgttagcaggagctntgtcccttcctatnntttccnnccactt

SEQ ID NO: 81131 - DNA, 1145 bp, Homo sapiens
  misc_feature (1066)..(1066): n is a, c, g, or t
  misc_feature (1068)..(1069): n is a, c, g, or t
  misc_feature (1076)..(1076): n is a, c, g, or t
  misc_feature (1144)..(1144): n is a, c, g, or t
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgttntnngtcgatnatccgcgccctgagaaaagaagcacagctcacctgactgtgagcaaaatagcagactcgattcagtgnt

SEQ ID NO: 81132 - DNA, 2243 bp, Homo sapiens
  misc_feature (5)..(5): n is a, c, g, or t
gacanatagaaaagtttgtaaaaaaagcaggtggtacggtccggaattcccgggatgccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaa

SEQ ID NO: 81133 - DNA, 3197 bp, Homo sapiens
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcggaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaa

SEQ ID NO: 81134 - DNA, 3539 bp, Homo sapiens
  misc_feature (3408)..(3408): n is a, c, g, or t
  misc_feature (3419)..(3419): n is a, c, g, or t
  misc_feature (3437)..(3438): n is a, c, g, or t
  misc_feature (3462)..(3463): n is a, c, g, or t
  misc_feature (3467)..(3468): n is a, c, g, or t
  misc_feature (3511)..(3511): n is a, c, g, or t
  misc_feature (3525)..(3526): n is a, c, g, or t
  misc_feature (3532)..(3533): n is a, c, g, or t
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaatatgtgtgtatatatggttttgtcaggtgtgtaaatttgcaaattgtttcctttatatatgtatgtatatatatatatgaaaatatatatatatatgaaaaataaagcttaattgtcccagaaaatcatacattgcttttttattcaacatgggtaccacaggaacctgggggcctgtgaaactacaaccaaaaggcacacaaaaccgtttccagttggcagcagagatcaggggttacctctgcttctgagcanatggctcaagntctaccagagcagacagnnaccctacttttcagcagcaaaacnncccnnatgacgcagcacgaagggcctggcaggctgttagcaggagctntgtcccttcctatnntttccnnccactt

SEQ ID NO: 81135 - DNA, 3597 bp, Homo sapiens
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacaggagtgaaactctatctcaaaaaaaaggagctaactttaaatattaaaacagaaatgggttaaccagaaacaaaagattgatagatataggtcatgctaactttaataaaaaagaatcttgggtggctacattaataccaggcaaagtagatttcagagaaaacaatattactggaggataacagagggaattttcatagacaatgtgttcaattcattacagtagaccataataattctaaatgtatgtgcacctaataataaaaattgaaaacacatgaaacaaaatcgggtagcatgacaagggagaaacaggcaaattcaccattacagtaaaatattacacactcatcttcatgattgtagaacagtcgacaatcttcaggatgccagaggctaaacataccataaccattgatctattccatatggacttcgcaaggagcaatatattcttcatttttcccggaccgaaattactaggaaccgtcggtgcaacagtcaattgtcatttacaccttttggtacggataaaaaaccgcacaggtgggatactgacataagtaacctcaaaaacgagccattgagaaaatgtttgcacgggaagttgaggctcttctcgctctgcactctattgctgagctgtccgcctctccccctcccccgaacacaacaacacaagacacacaaacacacacagcgaaaaacacacacaaagaaaaaagaacagaagcaggaccagaa

SEQ ID NO: 81136 - DNA, 2416 bp, Homo sapiens
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctccacgttgagtgaagctcatcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaa

SEQ ID NO: 81137 - DNA, 2311 bp, Homo sapiens
aaaaaaaacttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccaggtaggaggcggttcctgtggccagagcctgccacatcctcagggaccgggggcagtagggactaacggttctctctatccttcatccctctttgtcagagatagggagcaggccccatcttgccttcttaacactactcacagatggcagggccaagcaagtggctgagggagcttggaggaagactgagaaagaccctgtcccatcaccttttcctgaccaatgcccgtggctctgggtgtggccatttcaccagtgcagtcagacgggggccgccctccttccctggcctgccatgcccatcctagcttcctccccaacgctgcccaccaaattcatcggcttctgcttccatctctccttc

SEQ ID NO: 81138 - DNA, 408 bp, Homo sapiens
aatattcatttgagagctagtaaaaatattctcttaacttactgagagttcagttttaataggtgatgttaattagaaaggatctatactgtctagtttatggaggtattaaagaatttgacaattagataaaatagaaaataattgcaaaaataaatatatgtttctttttatcagctcacctttgagtttgtagttttccaaatgaaatttagttcgtatatagtctttgtactcaggaactttgggatgggagataaattactactaaatggaagcggcagaatgaatacttcatcaacatgtcaggaaaatgcaaaggtcagtctttaggaatattgacacctaggcttttttctatttcagacattcaggaaaaaataaagctcatcatctgttatttgaatt

SEQ ID NO: 81139 - DNA, 4231 bp, Homo sapiens
  misc_feature (3182)..(3182): n is a, c, g, or t
cggagttctgcaccggcgggggcggggctctgcgtggccggggcgggctcggggatccgcggggcacgagccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatgggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagccagaaacgtttgagcatctttttatcaagcatacagcatcagtgacatgtggtcctcttcttttggagcctgaaacaatttcagaagatatcagtgttgatacatcatggaaaaataaagatgagatgatgccaacaactgtggtctctctactttcaacaacagatcttgaaaagggttctgtttgtattagtgaccagttcaacagtgttaacttctctgaggctgagggtactgaggtaacctatgaggncgaaagccagagacaaccctttgttaaatacgccacgctgatcagcaactctaaaccaagtgaaactggtgaagaacaagggcttataaatagttcagtcaccaagtgcttctctagcaaaaattctccgttgaaggattctttctctaatagctcatgggagatagaggcccaggcattttttatattatcagatcagcatcccaacataatttcaccacacctcacattctcagaaggattggatgaacttttgaaattggagggaaatttccctgaagaaaataatgataaaaagtctatctattatttaggggtcacctcaatcaaaaagagagagagtggtgtgcttttgactgacaagtcaagggtatcgtgcccattcccagccccctgtttattcacggacatcagagttctccaggacagttgctcacactttgtagaaaataatatcaacttaggaacttctagtaagaagacttttgcatcttacatgcctcaattccaaacttgttctactcagactcataagatcatggaaaacaagatgtgtgacctaactgtgtaatttcactgaagaaaccttcagatttgtgttataatgggtaatataaagtgtaatagattatagttgtgggtgggagagagaaaagaaaccagagtcaaatttgaaaataattgttccaaatgaatgttgtctgtttgttctctcttagtaacatagacaaaaaatttgagaaagccttcataagcctaccaatgtagacacgctcttctattttattcccaagctctagtgggaaggtcccttgtttccagctagaaataagcccaacagacaccatcttttgtgagatgtaattgttttttcagagggcgtgttgttttacctcaagtttttgttttgtaccaacacacacacacacacacattcttaacacatgtccttgtgtgttttgagagtatattatgtatttatattttgtgctatcagactgtaggatttgaagtaggactttcctaaatgtttaagataaacagaattc

SEQ ID NO: 81140 - DNA, 2939 bp, Homo sapiens
  misc_feature (2890)..(2891): n is a, c, g, or t
cccgcaccttgggcgaggagttcggagcggccccatcgcagagcccacggccagccgagcgcgcgcgacgcaggtgcccgagccccggcgccgccgcccatctctgccttcggtcgagttggacccccggatcaaggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagaaaatgcctggcacaaaggaactactgggtggaggttggttgacttaggaaatgcttgtannctacgtcctacctcgtgcgcacctgctctccctgaggtgtgcacaatg

SEQ ID NO: 81141 - DNA, 3141 bp, Homo sapiens
cggagttctgcaccggcgggggcggggctctgcgtggccggggcgggctcggggatccgcggggcacgagccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatgggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataaaa

SEQ ID NO: 81142 - DNA, 397 bp, Homo sapiens
ccttttattctgccctcctcgattgttagtttggtggagtatcaattcttagaaatagcctttccaagagaacattgagataattcctgccttaacatatagtatccagtgttgcttctgagcagtcagatactattgtgatttttactcctcactgtttacttataatttcctttttaaacagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataaaa

SEQ ID NO: 81143 - DNA, 2445 bp, Homo sapiens
cggagttctgcaccggcgggggcggggctctgcgtggccggggcgggctcggggatccgcggggcacgagccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatggcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacatgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaaaaaaa

SEQ ID NO: 81144 - DNA, 2313 bp, Homo sapiens
cagctctttagacatggcgggcgttaactctcgtggcattatccttcagtggggctattggactgacttttcttatgctgggatgtgccttagaggattatggcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacatgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaaaaaaa

SEQ ID NO: 81145 - DNA, 2380 bp, Homo sapiens
attttccatgaaagaagttgatgtgtgcagaactttcagtacccaatattgtaattgcactatttataatcttaccacttgagttttacttaaggcaatcattgtcaattaaaaacaagtagagaaatatgtctaattgggaacatgttaaggatgataccagacttaattaacaagcatcacagaagtaattagactcattactgaacagttcattgtctcctgttacattattaagccttttagcagctttgtgtaacatttcattggatgtttctaatgcagaaaataatagggattgcaaagagtacaatatgaaggaagtaaggatttaatccttcttttcttgtctttcagatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacatgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaaaaaaa

SEQ ID NO: 81146 - DNA, 2835 bp, Homo sapiens
agaagatcatggggaaggacattgcaagcagggggcacagctagcgcaaaggccccaggataacagctatgagctcaagagtgttcaagggacagaaaaaaggctggtgtggctacagattaagcaaatgaagggaaaagagtacaaaatgaatggaagaagtagataataccagaccataaaggctttgtaggctagggcaaggaatttggggtttattctaagctcttaaaaggtttcaagcatgcgtgcactcaaaagatctttaccgaactagcttttgcaagacactctactatgttctatagggaaggcagaaatgaccaagttaaaattctgtctttgaagaaattgtggctcagtggtacagaaaacagtaaagtttctagggtatatattatatagtggcttcttaacacaatataagctacctacatagtaattttaaaattatcactacttatctatccctggtagaaatcatcttatgttctaatattcacaattaattaattttttgacctaaacatttaaaatagcaatgattttgaaatagtagtatgtctttcatttaaaatgtaactgttacttttctttttggattttgcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacatgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaaaaaaa

SEQ ID NO: 81147 - DNA, 2331 bp, Homo sapiens
cagctctttagacatggcgggcgttaactctcgtggcattatccttcagtggggctattggactgacttttcttatgctgggatgtgccttagaggattatggcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacatgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaaaaaaa

SEQ ID NO: 81148 - DNA, 2255 bp, Homo sapiens
cgcgctgcaggattcggcacgagctctcgtggcattatccttcagtggggctattggactgacttttcttatgctgggatgtgccttagaggattatggcgtttactggcccttattcgtcctgattttccacgccatctcccccatcccccatttcattgcctatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacatgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaaaaaaa

SEQ ID NO: 81149 - DNA, 1264 bp, Homo sapiens
  misc_feature (1256)..(1256): n is a, c, g, or t
cggagttctgcaccggcgggggcggggctctgcgtggccggggcgggctcggggatccgcggggcacgagccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatggcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaacttcgagggggggcccggtacccaatttggcctataggtgagtggaatttcagttcacttgncggttgtt

SEQ ID NO: 81150 - DNA, 2391 bp, Homo sapiens
cggagttctgcaccggcgggggcggggctctgcgtggccggggcgggctcggggatccgcggggcacgagccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatggcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacatgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaaaaaaa

SEQ ID NO: 81151 - DNA, 5106 bp, Homo sapiens
cccgcaccttgggcgaggagttcggagcggccccatcgcagagcccacggccagccgagcgcgcgcgacgcaggtgcccgagccccggcgccgccgcccatctctgccttcggtcgagttggacccccggatcaaggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggagcttttatgaatagttcatggtgaggacagaacttttctactttcagacagactgcttgctagttttatgaattcagcacacgaattatgctgtgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttctataaaaaatatgatgtaca

SEQ ID NO: 81152 - DNA, 5045 bp, Homo sapiens
cccgcaccttgggcgaggagttcggagcggccccatcgcagagcccacggccagccgagcgcgcgcgacgcaggtgcccgagccccggcgccgccgcccatctctgccttcggtcgagttggacccccggatcaaggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggaggttttatgaattcagcacacgaattatgctgtgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttctataaaaaatatgatgtaca

SEQ ID NO: 81153 - DNA, 3829 bp, Homo sapiens
gggaggtgagagagcagcattaccacctgcgctccacctcctgtcagatcagcgcagcattagattcttagaggagagcagaaccctatcagtcaagtgggcatgctctcctaatgaccatctaatgcctggtgatctgaagtggaacagtttcatcctcgaaatcctgaaccatctaccatcccccattagtggaaaaattgtcttccatgaaaccggtccctggtgccattgttgcttttattaatgtatactaattgactatttttgtatcttttaaaggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggagcttttatgaatagttcatggtgaggacagaacttttctactttcagacagactgcttgctagttttatgaattcagcacacgaattatgctgtgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttctataaaaaatatgatgtaca

SEQ ID NO: 81154 - DNA, 1493 bp, Homo sapiens
agaagatcatggggaaggacattgcaagcagggggcacagctagcgcaaaggccccaggataacagctatgagctcaagagtgttcaagggacagaaaaaaggctggtgtggctacagattaagcaaatgaagggaaaagagtacaaaatgaatggaagaagtagataataccagaccataaaggctttgtaggctagggcaaggaatttggggtttattctaagctcttaaaaggtttcaagcatgcgtgcactcaaaagatctttaccgaactagcttttgcaagacactctactatgttctatagggaaggcagaaatgaccaagttaaaattctgtctttgaagaaattgtggctcagtggtacagaaaacagtaaagtttctagggtatatattatatagtggcttcttaacacaatataagctacctacatagtaattttaaaattatcactacttatctatccctggtagaaatcatcttatgttctaatattcacaattaattaattttttgacctaaacatttaaaatagcaatgattttgaaatagtagtatgtctttcatttaaaatgtaactgttacttttctttttggattttgcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctggaattgttcttaaattcctgcctcttaaatcttacagtaatccacagatactatgctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagagtacacattgtaggtataatttattcaattatttgctattcactgtctttcctactatttgattttattccctccaattacgttctattttaattttatgaaactcttatttgaggcattgaatatcagataagcgcaagtcttgttcattcaattaaaatagaacgtaattggaggtcgacc

SEQ ID NO: 81155 - DNA, 1050 bp, Homo sapiens
cggagttctgcaccggcgggggcggggctctgcgtggccggggcgggctcggggatccgcggggcacgagccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatggcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctgggctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagagtacacattgtaggtataatttattcaattatttgctattcactgtctttcctactatttgattttattccctccaattacgttctattttaattttatgaaactcttatttgaggcattgaatatcagataagcgcaagtcttgttcattcaattaaaatagaacgtaattggaggtcgacc

SEQ ID NO: 81156 - DNA, 777 bp, Homo sapiens
cagctctttagacatggcgggcgttaactctcgtggcattatccttcagtggggctattggactgacttttcttatgctgggatgtgccttagaggattatgggtaagttatcatttcaaaaagaactattcctctttctgtgtctttgtcactattagtatgggtgttagagagttcggtcaatttagcaccaagttctaaccagtgagttagtggagcccagtttatgaacacagtccctttgtgggtcaggtgtacttttgcagagggctctgttaaaaattgatgtattcattccataagcatttgtttaacacctactctggactagctggggacacacaaatgaagagagagtcctgtcctcaaagaggaggtaaagttctagttgtgagtgagagacaggcaaacggtctagtcagtaatctggcagctgcagtggagatgccagcacagtacgctggagctcggataaagtgcacctgagtttcagtgggacagtcagggaaggctgcatggcagaggttgtatctgagccaagactaggtggatgaataagagtttttcagggtgatgagtcaggggaggacattccaggcagagggaacattctacacattttttcattcaaccattgttggttgaatgcttcccatgtgccagctactgttatgggaactagggattaagacataagaaaacaaaggtcctgctctctcagagtttgtgtttcagtgggggagacggacagtaaacaacaaaagtatgcatactgt

SEQ ID NO: 81157 - DNA, 330 bp, Homo sapiens
cagctctttagacatggcgggcgttaactctcgtggcattatccttcagtggggctattggactgacttttcttatgctgggatgtgccttagaggattatggagatgccacaacacccagctgattttttttagaagtttttgtagagaccgagtctctctgtgttgctcaggctggtcttgaactcctggcctcaagtcatcctcctgccttggcctcccaaagctgtatcttgatagtgaaccaggattatcatctatattggaagtcagcaaactgccacatataacctgctacctgtttttgtaataaaggttttattgaaatac

SEQ ID NO: 81158 - DNA, 3042 bp, Homo sapiens
cccgcaccttgggcgaggagttcggagcggccccatcgcagagcccacggccagccgagcgcgcgcgacgcaggtgcccgagccccggcgccgccgcccatctctgccttcggtcgagttggacccccggatcaaggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataaaa

SEQ ID NO: 81159 - DNA, 612 bp, Homo sapiens
cggtacccgactacatacttccgatgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgccggaagtatgtagtcctggtatctccaagaatgggcagacccgagagcatgcccttctggcttacacactgtgtgtgaaacaatctaattgtcggtgtaacaaaatggttccactgaccacctacagc

SEQ ID NO: 81160 - DNA, 2329 bp, Homo sapiens
ggggcggggtctggagcagcaggcgccgcgtttgcgagctaagctctcgtggcattatccttcagtggggctattggactgacttttcttatgctgggatgtgccttagaggattatggcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacatgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaaaaaaa

SEQ ID NO: 81161 - DNA, 2258 bp, Homo sapiens
cggagttctgcaccggcgggggcggggctctgcgtggccggggcgggctcggggatccgcggggcacgagccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatggatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacatgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaaaaaaa

SEQ ID NO: 81162 - DNA, 1223 bp, Homo sapiens
cggagttctgcaccggcgggggcggggctctgcgtggccggggcgggctcggggatccgcggggcacgagccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatggcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaagtcgaccggccgctaatttagtagtagtag

SEQ ID NO: 81163 - DNA, 1219 bp, Homo sapiens
  misc_feature (1212)..(1212): n is a, c, g, or t
  misc_feature (1217)..(1217): n is a, c, g, or t
cggagttctgcaccggcgggggcggggctctgcgtggccggggcgggctcggggatccgcggggcacgagccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatggcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaggggggggggggggggggngaaanct

SEQ ID NO: 81164 - DNA, 5205 bp, Homo sapiens
cggagttctgcaccggcgggggcggggctctgcgtggccggggcgggctcggggatccgcggggcacgagccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatgggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggagcttttatgaatagttcatggtgaggacagaacttttctactttcagacagactgcttgctagttttatgaattcagcacacgaattatgctgtgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttctataaaaaatatgatgtaca

SEQ ID NO: 81165 - DNA, 5715 bp, Homo sapiens
cccgcaccttgggcgaggagttcggagcggccccatcgcagagcccacggccagccgagcgcgcgcgacgcaggtgcccgagccccggcgccgccgcccatctctgccttcggtcgagttggacccccggatcaaggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggagcttttatgaatagttcatggtgaggacagaacttttctactttcagacagactgcttgctagttttatgaattcagcacacgaattatgctgtgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttctataaaaaatatgatgtacatttgtcttgtgtatttgtcttcatttcacatgtccatagtaaatatttttacgtgaagttatttataaggaatagtaatttaccagtttgtgatcatctctttcatcatcattgttctctacatatgatattattagctcttattttcagatagtctcaagcagattctcagtatacagcagataagtttttaatagtcaacacaattattttactttcataccatatcttatttcacaacatagttattttaactgtttttagacaagttattttggtcatttcatttcaatccacttttttctattttgggctaacatttttagtttatgggaatgtaatttgctacaaaatattaggaaggaaatatcttcagaagatagcattttccaatgacagtaaccaatctttcctgagagctaagcacttgcagacactaatttatttctagccacaataccatgaagcacatttttagagatgatgaaattgaaaggcagagaggttagtgtacttgttcatggttgtagaattggaagaactcaagtctaagtctgtcttgtcccactttcaaatgctatcatcttaaacgggctcttccttatgctt

SEQ ID NO: 81166 - DNA, 989 bp, Homo sapiens
cagctctttagacatggcgggcgttaactctcgtggcattatccttcagtggggctattggactgacttttcttatgctgggatgtgccttagaggattatggcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctggaattgttcttaaattcctgcctcttaaatcttacagtaatccacagatactatgctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagagtacacattgtaggtataatttattcaattatttgctattcactgtctttcctactatttgattttattccctccaattacgttctattttaattttatgaaactcttatttgaggcattgaatatcagataagcgcaagtcttgttcattcaattaaaatagaacgtaattggaggtcgacc

SEQ ID NO: 81167 - DNA, 399 bp, Homo sapiens
aaaaaaccctcctttttttttcccccttttccccaaaaacccccccccaaattctccagcaagggacccaggactggcaggaaatgagaggcagaggcctggcaaggagagacagcttataattctgacagcaaggtgcttagcatgtagaatgcaaaatgcaaatgctgggaaacatcctcaatcatttctggaatggaaatctttccctaatgagcgatgacgatggcagagagctgattgcactgaagaaaaactgcttaaaattcataatcaatcaagcgagttgattttagtcttttgtaaccaagctatcccattctagcttcctttattggccaactggagcttatcactccctaccttgttcccttcatctagctcagatggtaggtccca

SEQ ID NO: 81168 - DNA, 452 bp, Homo sapiens
ctatcatcctgtcagaggtcggcttgttgaccgtcaggcatgggccagccagtggtcaacatggccatgatcttcctgcactttcctctggggtcacttctcaccatcccagcaagggacccaggactggcaggaaatgagaggcagaggcctggcaaggagagacagcttataattctgacagcaaggtgcttagcatgtagaatgcaaaatgcaaatgctgggaaacatcctcaatcatttctggaatggaaatctttccctaatgagcgatgacgatggcagagagctgattgcactgaagaaaaactgcttaaaattcataatcaatcaagcgagttgattttagtcttttgtaaccaagctatcccattctagcttcctttattggccaactggagcttatcactccctaccttgttcccttcatctagctcagatggtaggtccca

SEQ ID NO: 81169 - DNA, 613 bp, Homo sapiens
atggtagattatctttttgatatgctgttggactcagttcactagtattttgttgaggattttggcatcaatgttcatcgggggtactggtctgtagtcttctttttttgttcttaatattttcttattttcattttgcctacacagatcaaaataaatgttgatgtgaatagtaaatctcacatttaaagaaatacaaatttccctttgtttataactcattcatcagttaaacaaatatttactggtcatttgttacatcctagctgatgagaaaacttcagaaaacaaaatctttgctcccagggactttacattctagtggggattacaaatgtttttaaaggattatttattggggtagtgataagtgctttagcgtgttaaaggaatgaagaatgctcaggactgctgctttagataaggctttcagagaactccttcctctgtgaggtggggacatgaacagaggcctaaatgaactgagtgcattacgtggatctaggcagatgggtgcacagctgcaaaggcctcggggtaagagcacacttgtgtccagtgtggtgcaacagtacggtgagggcaacaaagtgataggagaaaaggctccaga

SEQ ID NO: 81170 - DNA, 269 bp, Homo sapiens
atttccttggctgaaatttagacagaaaatcaaaggtaacacacagactacctcatgcaaaaaacatgattggatattttataaacctgcttaatcaagctcacatttgtagcgcttgatgttaaattctaagccactaacttctttcagagtaatggtccttctcctttgatagatcagggcccctttgagaatctgattgagaaagggaaaaataaaccaccataactctttagagaagtatacaaattcacttatacaaaaagact

SEQ ID NO: 81171 - DNA, 706 bp, Homo sapiens
ggggcgctggtcggtgcgcgggctgggacgctaagtcatgaggaattaaactgggaaacctggcgtgggtccaggcgccttccaggaggcatccggcgcggcccggacgtgcttctacccagaaccaccccctccaggccggggtgcacttaacggggctatacaaagagtctgacactgttattgcccatctgaactcgtcaactgagaaggaaagagatggtttatgctgtgaataaaatacagttgtgctgtgatgtaaatcccctcatcctggagcagctgagcaaggtctaaggcaggaagaaccttcaagcaggtcatggctgtaagcctcctgagtttatcccagcaagttgtataagggattatctttttatctgcatattatgacatatgtgaggatgtgtaaaggtttggcaagcactggcctactcaacagccagtcctacctaacttcagaaatctttcttgtgggcaaatgtcaggagatagggcccaggcccaggtccagctacaaagaatgaatacaattaaagtgctacttccattcacctcaccccagattagtttaggcaagagctcaggatgcagttttgacatttgaaagataaggagtagtctgctgggagcctgataaattgaaacagggatggcacagttctaaatattattaaataatagtaataatattaagtattactga

SEQ ID NO: 81172 - DNA, 400 bp, Homo sapiens
aaaaaaaaaaaatctcatgaagtttacctttccaggttttggacttgcttgggaactgtcactcttccaccccttatatggctccccttcggaatagcattgtttatcttataactgttccaccattataatttaaaagtacacaactgatttgattttacatctggagaagaatgttggctcagcatgaatgttacattgactctcacccttatctgattcagatgctatttaaatgagactttgattttaggcttcagagttaatgatagaatgagtcaagacttttgatggtgttgggatggaataaatgtattttgcatgtgaggaaatacattggggtggagattacaatattattgagtttatttgtcccctgaaattcatacgttgaaagact

SEQ ID NO: 81173 - DNA, 689 bp, Homo sapiens
ctcagttctttagaacagctaaaactgcatccaatcactgtctcttgtaccaatctaaaatcagtgcccagaagactcaaattttactggaaaacaaaagggaagccaagtgtcctgagactgctaaattccaccaaccaccagacagctctctacaacaaagagttaattggcagctgtgagacttgaggcaggtatcacggatgtgtctaaaggaaacgttaagcttctgatgtttctccctaatcctcggagcaacgttctcaaatcagactcctctcatcccagatgacccaagaatgcttgctatttcatctctttctaagagaacttctgatccaattccaatctggtaaatagataagaaaattgagactcatagcctctcttactcagctgtttacccatggaggcaggaaccaagacagttctgcacagccgtctatccccaggatctaacccctggctgccacataagcatcctggtggccttatggaactgacaaacactaatcaacacaactagtgtgcctggtgctatgctaggaggcgacagaagaaaaagacacaagacctgccttcagtagctcataatggagaagacagttgtacatacaatttgacatgatggatggtgtggctgggacatatatgtgacactggtgatgggtgccaggaagacagaccca

SEQ ID NO: 81174 - DNA, 559 bp, Homo sapiens
actgggctggaaacctagactccagcgtctggggataggagggatggtggggaatccgctgggaaaaactgggctgtgatcaagagaatttatcagtatctgagtttttccaccctggaaggagtgcgggcagacttactgtttaaacattgggagcttatgatggtaaagcgccttagttctggagccaggtatacccattaatgaccccaactgggccagcctttctgtagccatgcccttggattgttgctctccttctaggtttgactatgtggtttgcttcagccactagaacaatagcaaacatgatacaagcagaggcttggaaagtgcttatgcggccgggtgtggtggctcacacctataatcccagcactttgggaggccagggcgggcagatcacaaggtcaggagatcgagaccatcctggctaacacagtgaaaccccgtctctctactaaaaatacaaaaaattagctgggtgtggtggtgcacacctgtagtcccagctactcgggaggctgaggcaggagaatagcttgaacctgggaggcgg

SEQ ID NO: 81175 - DNA, 406 bp, Homo sapiens
ttctcaaacatcccatggcaaatacagctttgaattctttccccaacacctgtctctcccagcctttgctgtccagcaaatgatagaatccacccacttactcccctccaagtagaagtccttcccccaagtttgtcctcattcccactcccaccgtgcgcctgctctgctccaggtgctggctgctgtctacaaggctctgagtgaccaccacatctacctggaatgcaccttgctgaagcccaacatggccaccccaggccatgcttgcactcaagaagttttctcatgaggagattgccatggcgaccgtcacagcgctgcgccgaaaagtgccccccgctgtcactgggatcaccttcctgtctggaggccagagtgaggaggaggcgtccatcaacctcaa

SEQ ID NO: 81176 - DNA, 724 bp, Homo sapiens
gccagtgagaactcattgaagttggcactgtgttgtttcgacattgcccctgtcactttttaagcattttctggcaccacaagatgtttcaggcttcctcacattttccctatctcagccctggcatcagtcattctctaagaagctcccagttccttttattccagaaaaaaggaacttagaaaccaagttgtttcttgatgccactggaaaccaagatctggacagaatatatactcctggctagagtatcattggcggagtgtcattgcttgtaggcctgctcagcagacagagctagaaaacatatatgtatatatgttaaaacatgcaaatacaagcacctgaatttattattctatccatctgtatgttattaaaaaccgtgagccaggtatggtggctcgtgcctgtatcccaggactttgggaggccaaagtgggaggatcacttgagcccaggagttcaagaccagcctgcgcatcatagcaagacctcatcctccaaacgtttaaaaaataaaaaattagccaggcatggtggtgcattcctgtaatcctagctacgtaggaggctgaggcaggaggatcgcttgagttcagaaggttgaggctgtagtgaactgtgattgtaccactgcactgcagcctgagtgacagagcaagactccgtttcatatttttaaaaataaataaaaatcatgagtttagatacggttttaatt

SEQ ID NO: 81177 - DNA, 97 bp, Homo sapiens
aatgctgatgactttcagttctagacatggatcctacttgaggtctgcttatacttcttttcttgcagccatgaaacactccaatcccctccccctg

SEQ ID NO: 81178 - DNA, 543 bp, Homo sapiens
tggaacaattgaagaagaataggcatttgttcattgtgattaattccaaataatttttgcagacactctgcccctaggaagtggaacataagtcttcacttcttatttgtgtgttgtgtgtagtgacttctttttgaaacatacaacatggaaaggagaagaaaaaaacagtaatttcacagtgcagaaatttgattggaactatctcattcaggtgattaaattaacatcaaaagtgataaagctgttgcagtctgtacccttaacaggatgtgatgagaatggcaatttccctctgtggtcttcctccctgaaacctacaatccattctaatcatgaaagaaacaccaaagaaatcccaaattaggaatgccaatgtcatagcaatcatgcaaacttggagaaattgtcacagtcaaagtcgattaaggagcatgaattgtaaatgtaatgaggtatcctggataggatcctggaacagaaactcgacattaaatgatgactaaatcaatctgaataaagcgcggatggttaataaaagtg

SEQ ID NO: 81179 - DNA, 589 bp, Homo sapiens
ctgtagtcccagctactccaaaggctgaggcaagagaatcacttgaacccgcgaggtggaggttgtagagagccgagatcatgccactatactctagcctgggggacagagtgaaacttggtctcaaaataataatcacaatcatcatcatcatcatcatcatcatcatcaaggaaataagaaaatttctcagtgttgaagaaaggcacacatattcaaatcacaaaagctcactaaatactcaaaaggatgaaggagaaaagactccacctagacataacttcatgtaacttcagaagactcagaaaaattatctgaaacttgaaaataggcagaagagattactgggtaatctattttttaaaatggctactttacatctgtaggaacagagtttaagttgtagatgttatttcagtagagatgaaaataaggttctgttcaattggaacttcagaagttacagttcatggctttggagtacattaatcagttttgtatctatcccagcaatcttcttctaagattaccaataaatgcttagcttctcaaatgctctttgaacaagtgctccctcgttaatcactca

SEQ ID NO: 81180 - DNA, 717 bp, Homo sapiens
ctgtctgcaaaatgaaaagcttgaactggatggccttaagggtgattttcagctcgaaaatcccaatatcctaaccctcaagcttgggttagatccaactcctctgtgctcttcctgtaactaagcaatgagcccagtctatggtaaatcccccacccctaatcctagcctgtgacagagggagaccaagtgtctctgggtctctgtctgcccccagcaccttgagcagggcctggcatgtaggagttgttcagtagatgtttgtgaaatgaaaaaatgaatgaaaacaagcatacatggtctactcctctatttctttctcttaggtgacttggtttatcgtgtgagccattctggcagaagttagacttcatgtaaccccataatgaattcctgtctagtagatcactctaataggcaaaacatatcgcagctaccctctgccggcttcagagactggggtcactatcaaactggtccctggcccacctgcttaaatgctgtggctcctaaccactctttgtgactttgctgcagctacagatatcaagaactccagtgggccatggtacttcttggtccatggccgagggattatgcaaaagctacatccatgcaggagatttccttcatatttggatagtttcaaagataagagcatcttataataaaggggaaagaaacttcagaatgtcacaggcaaagtcttaggaagtg

SEQ ID NO: 81181 - DNA, 540 bp, Homo sapiens
ggctctgtgtttctagagcatcttggtttctggtgcgttatgatccaatgacatttactgcctatcagaaacggcaaatgatgtggagttgaaattattctaacaaaaatataacttttctaatatctgttgctgtttttctgttgaaaatgagcaggtagaatatacattgataggaaatgtgaaaatttttgcttgtgatcccttagtccgaagatagttctgccaggtaagttttcttaaaaatgtttttttctgtcctggcgcggtggctcacgcctgcaatcccagcactttgggaggccgaggcgggcagatcacttgaggccaggagttccagaccagcctggccaacatggtaagacccccgtctctactgaaaatacaaaaattagccgggcatagtggcgtgtgcctgtaatcccagtttcttgagatgctgaggcagaggaattgcttgaacccaggaggcggaggttgcagtgagccgggatcgcgccactgcactccagcctgggcgacagagcaagacgctgtttc

SEQ ID NO: 81182 - DNA, 888 bp, Homo sapiens
tccggtggtgccagcactagcccccatgtcggtctcagagaaccttctccccacctctgagttattctctcagtgtatcgaagatatcagtcaactatcttctggattgcattgatgctattgagaaggcagcctgcagtctaaaagtcatggttttaaaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgta

SEQ ID NO: 81183 - DNA, 145 bp, Homo sapiens
ttgggacatatatgatataaatgggaaaggatacagggggcaatgtggacacaaagggaaaaagtggcaaggtccttggcaaataattacctatattgagctaaaattacctaaatcaaaagttacctgtccttgaggggtgtat

SEQ ID NO: 81184 - DNA, 443 bp, Homo sapiens
tacttgggaggctgaggcaggagaatggcttgagctcaagagtttgaggctgtaatgcaccatgatcactcctgtgaatagcccctgaactctagcctggatgacactgggagatgctgtctctaataaatacatgaatggtggagaagggtcaactctttcttacacaagaattccaaataatatatatagaaggaatgagggaagtagaaaattcccattagaataccacagtaataattgctgcagacaagatccattaaatgctaaaactagtgggcaaaactttaaggtgaaacacagttgcacatccttaaagtatcaccttcaggctgggcacagcagctcacgcctgtaatcccaacaaaaggctgaggtgggaggatcgcttaggctgaggagttccagaccagcctaagcaacatggtgaaaccccatgtcaa

SEQ ID NO: 81185 - DNA, 319 bp, Homo sapiens
agaccgacccagccccacgcagaaatcatcgcactcccagggcctgactcaggccgaccgcacaggcagttttcaaagtccatggggtcaaaggctgaggtggcgtcatcttccaggcctcccgacctttccccggattccaggtgacatctcagagcagcaggcgggcgggaggactcattcaccggggtcaccaccaggtgactgaggcacagggcaggcacgtgccttgaagtttagtgaaggtcccaacagagctggaagaacacctggatatggctgttgctttgcatgccggagaggagggggtctgcaacgt

SEQ ID NO: 81186 - DNA, 285 bp, Homo sapiens
taaagggttgttaaaaagaagaagacagggatcatatgtgacccgcaaagccaaaaatatttactgtctggccttttacaggaaaagtttgttgacccgttgaccctgacagaacattcccatcccacttggagttccctctggccccttggcagggattcctcccctcccccaggcagccactgatctgctttctatagatgtagttgcgccttttctagaattttgcatgaatgaaatcataccgtatgttgcctgttgtgtctggcttccttcacttatcat

SEQ ID NO: 81187 - DNA, 389 bp, Homo sapiens
tcctgggctcaagtgatcctcccgcctcagcgtcctgagtagctaagactatagatacatgccaccatgcccagccttttccatttatttgacttttatcttattctgacaggttttttgtgtgtgtgtgtgtgtgtgtgtgtgtgtggaatttttaaggttttctacccatgagattatgtcatctgcaaacaaagataattttactgtttcctttccaatttaggtgaattttttttttagccaagttgctctggctaggacttctactactatgttgataagaagtggtgaaagtggacattcttttcttcctcttgatcttacaggaaaagctttcagtcatttaccattgagtatgctattagctgtgggcttttcatatatga

SEQ ID NO: 81188 - DNA, 508 bp, Homo sapiens
  misc_feature (493)..(493): n is a, c, g, or t
aaatattaattttataatttgtatatattcattatttaggatcacatatgtttatgtaacatacccatttgcttgggtatcatttcataccagcaaactaataggaataattttgtgaatgatcttctattttgctaaatttgctaattttgctaaattttgctaaatttgcgagtgatcttctattaagtggagtccatagagcagtagagaataaaattagaaaaaatggccagccatggtggctcacacctgtaatcccagcactttaggaggctgaggcaggcagatcacttgaggttaggggttcaagaccagcctggccaacatggtgaaaccttgtctctactaaaaatatgaaaattagctgggcatggtggcgcatgcctgtaatcccaactactcgggaggctgaggtgagagaagtgcttgagcctggagtgcagaggttgaagtgagctgagatcacgcaactccagcgtggatgatagangtgagactctgtctc

SEQ ID NO: 81189 - DNA, 599 bp, Homo sapiens
aaaatacctttattggtgggcaagtgaaggaattgaatacgttcacctgccttacaatataatctttctgagttactagtgtttacatgtgaacattgaaccagacatttctgtaagcacactgaggttttccgatacctgtgcatagaaagtatatctaacatttggcacagtctctgggaattgtgtttaatgttagagatgaactgaattacctttaaaaaatttttttttcatagagacgtggtctcactctgttgcccaggctggagtgcagtggtgctgtcatagttcactgcagcctcaaactcctaggctcacgctatcctgctgcctcggtctcctgagtagctatgacgacagatgttcatcaccatgcccagctaatttttaaaatatttgtagagacagagtcctgcagtgttgcctaggctagtcttgaattcctgggctcaagcaatctgccttggcctcccagagtgctgggattacaggattactggcctgaattgccatttcaaacatggttgtgatttcatactcttgttggaaaagtataaaattaaattttaaggcaatgtcttcattttgaactttaa

SEQ ID NO: 81190 - DNA, 422 bp, Homo sapiens
  misc_feature (1)..(1): n is a, c, g, or t
ntactactactaaattcgcggccgcgtcgacccacattccaaaagtggagtggtaggtgttccagacagagtgctgattcaagagtgagtaggggtgtagggtgaaagttggctactaattcaagcctcacctgaggcagtgttgctcaaacagaaaagtgccctctctaattagctgcccccatatgcgcttagattaatgacagccaactaacttagaaaccccttccagagtaagctagccaaacaatagatgttccatggacatgacaaagagctaattttcttgtgctaaggaatttttagctcttgtatttgtggtggactgcctcatcacctaatgaaggtgaagtacattctccattttaggaggcagagttaaaacattttcctcctgtggatgtctgattagaaaaaaaaaa

SEQ ID NO: 81191 - DNA, 1196 bp, Homo sapiens
ttttttttggttcaaagtgaaattagtgcagtgattaatcccattttagagtctttgttcagcatgattgaagtttaatgtttttgctaggaaaaattacttggtgttttgatagagctgtaacacctacaataccaccagtagcattggttcttgagaggagacatagcatgcattccctcagatataatccttcaataaatactactgaagcagctctctaccaggaaggaaaacagcactcatcctcatcctcccgtggactcactgtttttgtcttgcctattctgtgctgtaattctcacatcttaactaaaggagctaccacaactaaacaaacagacaaaaaaaaatcagagtataccttcacaaaataagcagtctatatgaaataagggagttgcatttggtttttttgtcagtaagtctgtaatgctcgatatatcaactttcagaattacagtaagtcagagcaaagagaatgaaatctgtagctcagcttgtttatttttttggtttgcttctgctgaattttgtttcccccaagtcagaatacgagtctttttgtgttctctctcttctcttattcttccgagaagtgaaggtggtgggtgtacagcccatatttgtttactttttctgtagctcatatatctattattactggtggtttcttagtggaaatttttctttcactctcactttggctttacctccaagtgctttcttctcttggctgcaattgagcactataatttgtggctttccggagggggagccttggtggtcaggtggaggaggcagcccacattccaaaagtggagtggtaggtgttccagacagagtgctgattcaagagtgagtaggggtgtagggtgaaagttggctactaattcaagcctcacctgaggcagtgttgctcaaacagaaaagtgccctctctaattagctgcccccatatgcgcttagattaatgacagccaactaacttagaaaccccttccagagtaagctagccaaacaatagatgttccatggacatgacaaagagctaattttcttgtgctaaggaatttttagctcttgtatttgtggtggactgcctcatcacctaatgaaggtgaagtacattctccattttaggaggcagagttaaaacattttcctcctgtggatgtctgattagaaaaaaaaaa

SEQ ID NO: 81192 - DNA, 765 bp, Homo sapiens
  misc_feature (1)..(1): n is a, c, g, or t
ntactactactaaattcgcggccgcgtcgaagtaagtcagagcaaagagaatgaaatctgtagctcagcttgtttatttttttggtttgcttctgctgaattttgtttcccccaagtcagaatacgagtctttttgtgttctctctcttctcttattcttccgagaagtgaaggtggtgggtgtacagcccatatttgtttactttttctgtagctcatatatctattattactggtggtttcttagtggaaatttttctttcactctcactttggctttacctccaagtgctttcttctcttggctgcaattgagcactataatttgtggctttccggagggggagccttggtggtcaggtggaggaggcagcccacattccaaaagtggagtggtaggtgttccagacagagtgctgattcaagagtgagtaggggtgtagggtgaaagttggctactaattcaagcctcacctgaggcagtgttgctcaaacagaaaagtgccctctctaattagctgcccccatatgcgcttagattaatgacagccaactaacttagaaaccccttccagagtaagctagccaaacaatagatgttccatggacatgacaaagagctaattttcttgtgctaaggaatttttagctcttgtatttgtggtggactgcctcatcacctaatgaaggtgaagtacattctccattttaggaggcagagttaaaacattttcctcctgtggatgtctgattagaaaaaaaaaa

SEQ ID NO: 81193 - DNA, 437 bp, Homo sapiens
ctgctcttcctgcctccctctcaccttctcaaggacttggctccaacattatcctctttcctggcatattataaatgtttccctctactggatcattcctattagctcataacatgctatcatcgctctcatttaaaaatacaactaaaaacttcctgtacccatgtcccctccagccaccatcccatgactcttcccttttaacagaactcctctagagagtcgtctacactgatgttcccacctctactctatttgtttcctctccccaccactccaaacctatcaaggtcactcacaaccacctcttatcaaagccaataggaaactctccagcccacgaagaataagaagaaaagaacccctcggtgtcttggtttccaggccactagactctcactagtttcttccttcttcaaacagagtccttttcaatg

SEQ ID NO: 81194 - DNA, 431 bp, Homo sapiens
gaaagatctggaagcctgcttctttctcagattttagtcccctaaacccacacccctatgttgtgtcaatttagtttggactcagctaggaacctctgcaagtggaagttcttactgtattttttcctaataattatttattaaaaagaatcacttaagtgtccccacaaacatctggtagactctctctaagtccatataagcagccgtatttgacgtcttctaggaattaacaatatctgatagtcaaggtatccaggactatattttacaatgagtagagctgaattgtatttagcttttgtattcctagataaaaaagcacagtagccaacatctagtcagtaaccttacattaggagactttacctctattcagacagttttgaacccaagggaaaaaaaaaggaggctgacgaagatcagaaaat

SEQ ID NO: 81195 - DNA, 307 bp, Homo sapiens
gttgctgactgctgattggagatgacgtgtacccatcctctagacagtctgtgcttttcctgtctttggagcttccagttccacccccatcagtttttttctgaccactccatcttgccttatttctctctctttccttttgactggaagagtactcatcttttctaacatcttttcataaactgttttgatttcacttatattgatttttaacgtataatgtgctggtgttctatttcctcagttagatcagaaggcccctaaagacagggctccattggtgttaaactgccatcttcaaggtctg

SEQ ID NO: 81196 - DNA, 1230 bp, Homo sapiens
aaatcctggctgtcatgtacttgctatgggcctagagtagcttacctaaatgctactaaccttcctccataccattattgtaaagattaaaggtgatgcatctgttaagtaactaatagagtgcttattaaaaggtaggtgttcaataagtattaattccctccctttctttttcttactagtgcacttgtgtttttaatggatcatactttaccctagattgtattgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggatgcagctaatatacccagttggcccaaagcacctaacctatagttatataatctgactctcagttcagttttactctactaatgccttcatggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgtttttt

SEQ ID NO: 81197 - DNA, 313 bp, Homo sapiens
ccagctggtcataaatagtcacgatggtgtcggtgttgctgtccctgttcgtgacatctgtcctgctctgcttcatcttcggccagcacttgcgccagcagcggatgggcactaccggggtgcgagcggcttggaggaggctgcccccacgttctcattgacttccttactaagcatagcaaacagaggaagaatttgttatcagtaagaaaaagaagaactatatgtgaatcctcttctttacactgtaatttagttattgatgtataaagcaactgttatgaaataaagaaattgcaataactggcaaaaa

SEQ ID NO: 81198 - DNA, 1465 bp, Homo sapiens
ctccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggagaatccattccaatatatggccatgtggctctttggagcaatgttccatcatgttccatgctgctgacgtcacatggagcacagaaatcaatgttagcagatagccagcccatacaagatcgtttgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgcctgtgtggaaccactgactactggctctcattgacttccttactaagcatagcaaacagaggaagaatttgttatcagtaagaaaaagaagaactatatgtgaatcctcttctttacactgtaatttagttattgatgtataaagcaactgttatgaaataaagaaattgcaataactggcaaaaa

SEQ ID NO: 81199 - DNA, 2317 bp, Homo sapiens
ctccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggaggtacagagctcggcttctttgccttgggaggggagtggtggtggttgaaagggcgatggaattttccccgaaagcctacgcccagggcccctcccagctccagcgttaccctccggtctatcctactggccgagctgccccgccttctcatggggaaaacttagccgcaacttcaatttttggtttttcctttaatgacacttctgaggctctcctagccatcctcccgcttccggaggagcgcagatcgcaggtccctttgcccctggcgtgcgactccctactgcgctgcgctcttacggcgttccaggctgctggctagcgcaaggcgggccgggcaccccgcgctccgctgggagggtgagggacgcgcgtctggcggccccagccaagctgcgggtttctgagaagacgctgtcccgcagccctgagggctgagttctgcacccagtcaagctcaggaaggccaagaaaagaatccattccaatatatggccatgtggctctttggagcaatgttccatcatgttccatgctgctgacgtcacatggagcacagaaatcaatgttagcagatagccagcccatacaagatcgttttcaactagtggccccactgtgtccggaattgatgggttcttggtctcactgacttcaagaatgaagccgcggaccctcgcggtgagtgttacagctcttaaggtggcgcatctggagtttgttccttctgatgttcggatgtgttcggagtttcttccttctggtgggttcgtggtctcgctggctcaggagtgaagctacagaccttcgcgtgcacttgtgtttttaatggatcatactttaccctagattgtattgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggatgcagctaatatacccagttggcccaaagcacctaacctatagttatataatctgactctcagttcagttttactctactaatgccttcatggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgcctgtgtggaaccactgactactggctctcattgacttccttactaagcatagcaaacagaggaagaatttgttatcagtaagaaaaagaagaactatatgtgaatcctcttctttacactgtaatttagttattgatgtataaagcaactgttatgaaataaagaaattgcaataactggcaaaaa

SEQ ID NO: 81200 - DNA, 1541 bp, Homo sapiens
aaatcctggctgtcatgtacttgctatgggcctagagtagcttacctaaatgctactaaccttcctccataccattattgtaaagattaaaggtgatgcatctgttaagtaactaatagagtgcttattaaaaggtaggtgttcaataagtattaattccctccctttctttttcttactagtgcacttgtgtttttaatggatcatactttaccctagattgtattgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggatgcagctaatatacccagttggcccaaagcacctaacctatagttatataatctgactctcagttcagttttactctactaatgccttcatggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgcctgtgtggaaccactgactactggctctcattgacttccttactaagcatagcaaacagaggaagaatttgttatcagtaagaaaaagaagaactatatgtgaatcctcttctttacactgtaatttagttattgatgtataaagcaactgttatgaaataaagaaattgcaataactggcaaaaa

SEQ ID NO: 81201 - DNA, 1701 bp, Homo sapiens
gctggtaccggtccggaggttagggattgaggctctcctagccatcctcccgcttccggaggagcgcagatcgcaggtccctttgcccctggcgtgcgactccctactgcgctgcgctcttacggcgttccaggctgctggctagcgcaaggcgggccgggcaccccgcgctccgctgggagggtgagggacgcgcgtctggcggccccagccaagctgcgggtttctgagaagacgctgtcccgcagccctgagggctgagttctgcacccagtcaagctcaggaaggccaagaaaagaatccattccaatatatggccatgtggctctttggagcaatgttccatcatgttccatgctgctgacgtcacatggagcacagaaatcaatgttagcagatagccagcccatacaagatcgttttcaactagtggccccactgtgtccggaattgatgggttcttggtctcactgacttcaagaatgaagccgcggaccctcgcgttgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgcctgtgtggaaccactgactactggctctcattgacttccttactaagcatagcaaacagaggaagaatttgttatcagtaagaaaaagaagaactatatgtgaatcctcttctttacactgtaatttagttattgatgtataaagcaactgttatgaaataaagaaattgcaataactggcaaaaa

SEQ ID NO: 81202 - DNA, 1360 bp, Homo sapiens
  misc_feature (1)..(1): n is a, c, g, or t
  misc_feature (28)..(28): n is a, c, g, or t
nctttaaggtgacgtgactctcttctgnaaccgccgaatcaaatccattccaatatatggccatgtggctctttggagcaatgttccatcatgttccatgctgctgacgtcacatggagcacagaaatcaatgttagcagatagccagcccatacaagatcgtttgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgcctgtgtggaaccactgactactggctctcattgacttccttactaagcatagcaaacagaggaagaatttgttatcagtaagaaaaagaagaactatatgtgaatcctcttctttacactgtaatttagttattgatgtataaagcaactgttatgaaataaagaaattgcaataactggcaaaaa

SEQ ID NO: 81203 - DNA, 1841 bp, Homo sapiens
ctccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggagaatccattccaatatatggccatgtggctctttggagcaatgttccatcatgttccatgctgctgacgtcacatggagcacagaaatcaatgttagcagatagccagcccatacaagatcgttttcaactagtggccccactgtgtccggaattgatgggttcttggtctcactgacttcaagaatgaagccgcggaccctcgcggtgagtgttacagctcttaaggtggcgcatctggagtttgttccttctgatgttcggatgtgttcggagtttcttccttctggtgggttcgtggtctcgctggctcaggagtgaagctacagaccttcgcgtgcacttgtgtttttaatggatcatactttaccctagattgtattgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggatgcagctaatatacccagttggcccaaagcacctaacctatagttatataatctgactctcagttcagttttactctactaatgccttcatggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgcctgtgtggaaccactgactactggctctcattgacttccttactaagcatagcaaacagaggaagaatttgttatcagtaagaaaaagaagaactatatgtgaatcctcttctttacactgtaatttagttattgatgtataaagcaactgttatgaaataaagaaattgcaataactggcaaaaa

SEQ ID NO: 81204 - DNA, 2024 bp, Homo sapiens
ctccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggaggtacagagctcggcttctttgccttgggaggggagtggtggtggttgaaagggcgatggaattttccccgaaagcctacgcccagggcccctcccagctccagcgttaccctccggtctatcctactggccgagctgccccgccttctcatggggaaaacttagccgcaacttcaatttttggtttttcctttaatgacacttctgaggctctcctagccatcctcccgcttccggaggagcgcagatcgcaggtccctttgcccctggcgtgcgactccctactgcgctgcgctcttacggcgttccaggctgctggctagcgcaaggcgggccgggcaccccgcgctccgctgggagggtgagggacgcgcgtctggcggccccagccaagctgcgggtttctgagaagacgctgtcccgcagccctgagggctgagttctgcacccagtcaagctcaggaaggccaagaaaagaatccattccaatatatggccatgtggctctttggagcaatgttccatcatgttccatgctgctgacgtcacatggagcacagaaatcaatgttagcagatagccagcccatacaagatcgttttcaactagtggccccactgtgtccggaattgatgggttcttggtctcactgacttcaagaatgaagccgcggaccctcgcgttgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgcctgtgtggaaccactgactactggctctcattgacttccttactaagcatagcaaacagaggaagaatttgttatcagtaagaaaaagaagaactatatgtgaatcctcttctttacactgtaatttagttattgatgtataaagcaactgttatgaaataaagaaattgcaataactggcaaaaa

SEQ ID NO: 81205 - DNA, 1083 bp, Homo sapiens
cggattgggatcggacctacttgattcacttctgggaaatcaaggatctacgtaccatggattttcaggtgcagattttcagcttcctgctaatcagtgcctcagtcataatgtctagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgcctgtgtggaaccactgactactggctctcattgacttccttactaagcatagcaaacagaggaagaatttgttatcagtaagaaaaagaagaactatatgtgaatcctcttctttacactgtaatttagttattgatgtataaagcaactgttatgaaataaagaaattgcaataactggcaaaaa

SEQ ID NO: 81206 - DNA, 430 bp, Homo sapiens
gcccccattaccttctttgctgctaccacaacaaggtatattagcccttgaaattaaagatgttgctgtcccagttgtgcttgtcttcacctaaatgcatacagtcatattccaaaagactatatattagtgatatctatatagttcacccttcatatacatgagctcccgtgtgtggagtgaactaattgcagatataaaatatttgggaaaaaatttcatgtgtactgaacatgtatagactttttttcttgttatcatttcctaaataatacagaataataaccactgtttacatagcatttacattgtgttaggtattataaataatctgtacataatttaaactgtacaggagaatatgcataagtcatatgtgaataccacaccattttatatcaagtacttgagccatctgcagattgtggtg

SEQ ID NO: 81207 - DNA, 540 bp, Homo sapiens
ttccgtggctgacacaataaacattatctcaccgttgctgtgctccaggaatttgggagcaacatgacaggacgattcccactccagttctgtcatgaggtggcggtgagctcttagcccaggctgcagtcacccaagggcgtgactggggctggagggtgttcttcccaggtgggtcacccttgtggctggcaagccagagctggctgttggccagaggcctgggttccatccacgtggatctctccacagggccattgagggtcctcttccagagtaagtgattcaaggcagagcaaaagcagaagccacatgccttttacagcctagtctcagaagccacacattgtcatttctgcgctgtcttattggttacacaggtttgccctgctcagtgtgagaggagaccacaccagggtgttgacttccaggagaactgggtcctcaggggccatcttaagggctggctgtcacagctgtgatcacaaccctcagtcggtcccttatgaacaaatggtccaaccctgagaatagtttaaa

SEQ ID NO: 81208 - DNA, 502 bp, Homo sapiens
gtgggtcctcacaaaagcaaacatccacatagagacctacacataaatgttcatagcacctttacctgtagtagttaaaaactggaaacagcccaaatgttcaacaggtaaacaagtaaatagtagtatatctacacaacaaaccactactcagctatgaaagggaataggctcttgactcacacatcataggtaaatcttaatggtttcacatgtgtatatgtatgttaaaacttatcaaaacgtgcactttaaagatgtgtttatgtccatcatacttcaataaagctgttttttaaaaagacctactaattcaacgatttaagttgttataaatcagaacaaaagtgagaattattcccttttttttttttttttaattgagacagagtctcactctgtcgcccaggctggagtgcagcggcactatctcggctcactgcaacctccatctcccaggttcaagtgattctcctgcctcagcctcctgagtaggtgggat

SEQ ID NO: 81209 - DNA, 104 bp, Homo sapiens
catgctgggcactgccctccctagacaagacctgtctgtggactctttccagcgcagctgtttagccagacgctggccccgtctgcagccgtcacaggccctct

SEQ ID NO: 81210 - DNA, 458 bp, Homo sapiens
cctgcagcctggctaatgtcttgatggcaacttaacaagataccttaagccagaaccatctagctaatacactcttgaattcctattacaaacactgggaaataatcaatgtttgttgttttaagctgctaaactttgatattatttattttattcatttattttttgagacagggtcttgctgtattgcccaggctggagcgcaatggagcgatctcggctcactccagtctccatctcctgcgttcaagtgattctcctgcctcagcctcccgagtagctgggattacagacgtgcaccaccatgccgagctaatttttaggagagatggggtttcaccatgttggtcaggctggtctccaactcccaggctcaagtgatcctcccacttcggcctcccaaagtgctgggattacaggcatgagccattgcacctggccgagattatttattatac

SEQ ID NO: 81211 - DNA, 448 bp, Homo sapiens
ggcaatttaataccttaatcttcaggttttggaattttgccacaaatttagaaaccaaaaaagttggagatcacttcttaatttaagtcaagacagggttaggagaatattcttcattatgtagcttccaaatttagccttcttttcttcacaagcctgaactctttcttagtttttagtgttccatgactgtatctaccttaagaaagcccaataatgtacatcaaaattcaggtttgtaaaactaaagagaatgatcaatcactttatacaaagccagtgttcctataggaggggcagaagttcctgtggtacattcaatattgatattattcctaaaatatgcttacctataattctttcagggatttcctttttgttacatatcaaagtgtatttgcactgaaatgtctatgaatagataagagtacctttagtttgaaagaat

SEQ ID NO: 81212 - DNA, 641 bp, Homo sapiens
ataaggaactgccaataaaaaagaaataaaggaatcaaaacaccaaaacagaaatagaggtaatgtgaggtaattgaaagcactccttcaaggactttaggaattacactatttcaaaataaaacttgaaatgtaaatccaggaacgttatatagagttacttacgtttcattaatcaataggacacagtgctttatgatggccttaagtacaatttatagacgttattcaataaagaaagtctataaaaatacaaacaaaatttaaaatgccctgctcaaaaccaaatttttttcccaaagaatttcaactttcctcaaaacgtcaacaatctccaaaatttccatccaaataaaacagtttatataagacatgttaagtaatacagcactgttttatatatctgtctgcctcaaactcctgaatatacttcacaaatataaaacatctaatcaaacccaagtcttttcattatcaactaaaagactgagtgaatgttcaccaaaatatcactcacatctttatctctcctacccccaactccactctcccaactgcttccaatttccctttttctattaggggtactcctcctagtgccaatggctagaaatctcaattcaatcctgcttctttaaaat

SEQ ID NO: 81213 - DNA, 587 bp, Homo sapiens
ataaggaactgccaataaaaaagaaataaaggaatcaaaacaccaaaacagaaatagaggtaatgtgaggtaattgaaagcactccttcaaggactttaggaattacactatttcaaaataaaacttgaaatgtaaatccaggaacgttatatagagttacttacgtttcattaatcaataggacacagtgctttatgatggccttaagtacaatttatagacgttattcaataaagatttcccaaagaatttcaactttcctcaaaacgtcaacaatctccaaaatttccatccaaataaaacagtttatataagacatgttaagtaatacagcactgttttatatatctgtctgcctcaaactcctgaatatacttcacaaatataaaacatctaatcaaacccaagtcttttcattatcaactaaaagactgagtgaatgttcaccaaaatatcactcacatctttatctctcctacccccaactccactctcccaactgcttccaatttccctttttctattaggggtactcctcctagtgccaatggctagaaatctcaattcaatcctgcttctttaaaat

SEQ ID NO: 81214 - DNA, 189 bp, Homo sapiens
gacagtggtgagatgcaagaggtgaggtctctataagcaaaacctgtttcaaattgtccctgtagttggcaacccaggaagtttttatacttaggtatattgcaccacattaatatctaagatgtgtaagaaattcgtctttcaagtgggagaataactgtgaagagggatgtgaaaataaaactccgg

SEQ ID NO: 81215 - DNA, 450 bp, Homo sapiens
tactctgaagaagaactgagcaggatgagtggatagaaggtgtcaacagcagccgtaactggtctgggaagacccctcagagctgtccatatctgagcagagatctaatatgcattagatcagtatgcatttcccaaactgaaatgacaagggaacctctttgtcacagagcatcttgcaggactgcttctgagaacctgctttgagaaagtgggcatggagacagtcggagtagaaagtgggatcttcagagtcccaagacctgggtgctcatgttagaatggggactctgaatctcataaatgcaaagtaagacctttcatgtaggagtcttatcacccacccccaactgggaggtctctgcttcgacttcagggttggaaaagcactgcacatactctccccagctgccctggattcacgctgattctgcagggttcatgaagatgg

SEQ ID NO: 81216 - DNA, 585 bp, Homo sapiens
actggaattaaaacagagtttttaagttttttctttgcttgtttttgttcttttcttgtgatcaaagtgaagttgtcatcaaacttgttatattttctgaaccccttagggaaaccacaactcaaaaaagtctaaacagataaactaaaaataaaaagtaaaacatactatgagaaaaaatcatttatccacaaaggaagacagaaagaaaaaaagagaggacttccaaaacaaccagaaaacaaaaaacaaactggcagtagttaagtctttacctaacaataataaactgactgttgatggactaacttatctgattaaaagatacagaatggctcaatgaataagaaaacaagaccaactatatgctgcctacaagaaattcactttggctgggcacggtggctcacacctgtaatcctaacactttgggaggccacagtgggcagatcacttgaggtcaggggttcaagaccagcctggccaacatggcaaaaccccatctctactgaaaaaaaaaattagctgggcatggtggcttgtgcctgtaggcccagctacttaggaggctgaggcaggagaatc

SEQ ID NO: 81217 - DNA, 818 bp, Homo sapiens
cgagcccgcactcctcagcccttgggcggtcaatggggcgcggcgctgtgaagcagggggcggcgcctgtcagggaggctccggcggcgccggagggagtgggggtttgctcaggcatgccgggctgcaggtcccaagcccgtcccgctgggaagaggctgaggcctggcaagaattagagcgctgcgccggcaggccggaagtgctggcggacccagcgcaccctccgcagctgctggcccaggtgctaagcttctcactgcctggggccagcattgtcagctgcctgctcggaatgcggggccagccgagcccgcacccaccgggaactcgtgctggccagcgagcgccagcgcgcggcccaggttccacccgcgcctctctctccaaacctcccggcaagcagagggagccggctccggcctcagccagcccagagaggggcttccacagtgcagcggtcagctgaagggctcctgaagaggggccagagtggacaccgcagcctgaggaggtgcagagggagcgagggctgctagcacgttgtcacctctcaatagcaagaccaaagcttacagatgtccattatgtaaataggtaagaaatatctggttcttttctttgttgataagcttctcagcatttttttgtgttttaaaagtattttgtagtttatttgctatatggaatcaactttaattttcttacttcttattcaggcttttttataagtcactatatgaaaaaagtcttaaaatcctagtttcagaaagcaatgtaagctcaacaaatggagggtatctaacttctattgaaaa

SEQ ID NO: 81218 - DNA, 193 bp, Homo sapiens
atggggacaaatgttcaaacccatggcagcacatgaataaaacagaatagaaaagccaaaaattttaaaaaataagaaaacccaaaaataaacttaatgacatctggaagtctaataagtggtaaatatgccatctcaaatcaatagagaaaaagaagaccttcctaataaatagtcctgtcataaatgggta

SEQ ID NO: 81219 - DNA, 373 bp, Homo sapiens
acaaattgtgacatttcctaacaatgtgatattatacagcaatgaaaaagaacaaactactgctaaatgtgccaaaataaattaatatccctaagataatggtgaattgtaagtgccaaacacaactgagtacatactacatgagtccactttagaaaagctcaagaacaggcaaactgattgtagaaagaagtcagaacactggttactgctagaaagagagctattgattgggaagaggcacaaagcctatatcttcacctgagtagtggtgaaacatgtgtatataaacataaaaatgtttttatgtttaatatctttgcctttgtttatgttgaatatctttgcctttcatgcatttaaactaattaaa

SEQ ID NO: 81220 - DNA, 454 bp, Homo sapiens
aaaaattagctgggcgtgatggcgagcgcctgtaatccagctactccagcgcctgaggcaggagaatcgcttgaaccccggaggcggaggttgcagtgagctgagaactcaccattgcactccagcctggatgacagagtgagactccatctcaaaaaagaagaacaaactacagcggggagagggcgaggggaagaagatagtgggggaaaaagagcaccgagaaagggagaagagatggggagagctctattgtgtcactgaacattcctcagttaaagttaaaatgttctcataagtttgtgtgttttcaacttttgctcttccagttggtatattcttttcttcctccatctcctttttatacctccaaccacctttctctttttattttccaatgtttttctttcttctaagaacattgttaacgctggtaacactttacaatgttgca

SEQ ID NO: 81221 - DNA, 342 bp, Homo sapiens
ataactttcgtgtgtcatcaaggacattcttaagtaaaactggcattacaatttttttaaagaatatttttactgttaatattgcccggaagaaaagaatagagaagaatataatgacaactgggacagtttggtgctgcagtgaattaattacgtaggcaatcgagactctaataaggatattttgctccagcaattcctgattgtcccctgtagctgacgtgtactatgaaagttatcactgtggtattcttttttttttttttttaattgaaagcaagtttattaagaaagtaaaggaataaagaatggcttactccataggcaaagcagccctaaggg

SEQ ID NO: 81222 - DNA, 693 bp, Homo sapiens
ctcgttggtaagcatgttctagggagagctagtggtagacaggcccaggccacagcaggccttgtagatgggccagggctgcttacctgtgcactaggggtggtacttggccctgccctggcccctgtgtgggcttatcctctgctgagaccattgtggttctctggtgccagaggcacccagaggtctgtgatctgcctgctttgaggcgggaagggttgttccagttctgctttcccaagcggtggctgtgggcaacccttatgatccaggacgcatggtcatcttaacgagcagctggctttacacccagggcgagcagaggtcttaaattatgcccgttgtcctggagtaatttagagcagcctcttttgtattcaggcatcctggtttgcatggtaaggtatgaatatagttgcctttaaacagcacgatgaagtgggcgggttattgttctcatttcaccaaggaggataatgaaccttagcgatctcgagtgactttcccggccccatcccctttgaggggcagggctcgctctgcttccctgtctgggcaccaccctcctctctgcacctcagtccacgccgggatgtcctttctgacctcactgcagtggcacttccccctcaaccgggggtgcccagaacgaatgggtgtatttgggtgaagccagtatgactgtttctaccc

SEQ ID NO: 81223 - DNA, 448 bp, Homo sapiens
taaatacaaagacccatttccctgttatcacagcactgatactgaaagatagtaaaataataacagtaaattaattttatctgtctataaatataattggctatcacttattaagcttctaccatgtcctaatcctcacaacagcctctacaaagtaggaaccattatcctccttttataggtaaagaaacagaatcagaaagttaactgatgagctacaatttagttaaggggatatcaaaagacataataggcatgaaacagaagtataaaatgaagtctgagaaagaagtcatgaattctgactttggaaaattaagtatcattattgttatatccatgtacagcagttatgattaacaaaattatagaattcttcacataatgaagcaaacattttaaaatttaaaacatacggatgccctaggtaaggccagtagttttttta

SEQ ID NO: 81224 - DNA, 803 bp, Homo sapiens
gcagttgcgcagtctcggctcactgtaacctccgcctcctggattcaagagattctcatccctcagcctcccgagtagctgggattacaggcgcatgccatcacacccagctaatttttgtattaggtggtttttaaaggccaccgcttcttcagtgttctgcaccaggtctgggaatgttctcagctcacctagtcatgttcagaatggacaaatccctcagaggaagcagacacggtttctcgggacggtgatcctttagagccacatgcacatgcttgctttcttttattattatctttttttgagatggagtctcactccgtcaccgaggctggagtgggaggatcgtttgaacccaggagatggaggcgtcaatgagccgaaatcacaccaccgcactccagcctgggcaacagagcaagactccgtctcaaaaacaaaacaaaacaaagcaaaaaaaaaccaaaaaaaaaaaaaaaaacacttggtcgcacagcactaggcccatcggaaaagctctgtcgaaagaaccagcccgggttgaagagcggagggacccagataggtaacatcgacacaccggcggcgataagagctagggtcccccaaaagagagaccccggggacgaagagaaaataagggcgtagggagagtcccacgcagatataaaagaagggcccaggggtgtgaaacccgcagactctactagaaagaaaaccccgagtaagaggatcaggaacgacattcacgggagtctacaagagaggggcccacagacgagcacgaaataaaattagcc

SEQ ID NO: 81225 - DNA, 370 bp, Homo sapiens
gcagttgcgcagtctcggctcactgtaacctccgcctcctggattcaagagattctcatccctcagcctcccgagtagctgggattacaggcgcatgccatcacacccagctaatttttgtattaggtggtttttaaaggccaccgcttcttcagtgttctgcaccaggtctgggaatgttctcagctcacctagtcatgttcagaatggacaaatccctcagaggaagcagacacggtttctcgggacggtgatcctttagagccacatgcacatgcttgctttcttttattattatctttttttgagatggagtctcactccgtcaccgaggctggagtgcagtggcataatcttggctcactacaac

SEQ ID NO: 81226 - DNA, 334 bp, Homo sapiens
acactggactcaactgtttctgaattctgtgtcttcctttttctttatttacttcatcattttattatagtacatgtcaagtctcctgtcaggaaagagtacatggaaggcagagttgttgagtgtctgtgtctttctctgacctctcacttgatggtagtttggctggctctggaattctaggttgaaaaatttccctagaagtttgtagccactgcttcactgacttacagcatccactgctgctaatgagatgcctgattccaatctgatacttatttatttgacaatcagtaaatagtatttacattacagtgatctgttttcccacccc

SEQ ID NO: 81227 - DNA, 487 bp, Homo sapiens
ggcagcttccagggcgggctggactggggggagaatccctcatgtcccatgcacgaagatagcagcaggtggatgaggagcaggggtggagatggaacttagctaaacccccagtgagaggctgtggctgtgaaatcccaggatatttgcagcatgagctgggacaggattcatgtaggcacccgtggggagtcccagaaatacctggaggaatcatgcaagaggcctgtcctatgggaataagtgaatctcagaggtgatgggcgtctatggtctggggactgagggcagggaaaactgggaacttggcttaccttttatcgtgggcagcaccctctccagagagccctgggattggcgggagaggccaggacccttcctcgctgcagcctccagtcactccaaactgtaggaggggcaggctggccttggatttggtgagcctgggagcacctgtatcagtaacaagacttcccctctagcttta

SEQ ID NO: 81228 - DNA, 202 bp, Homo sapiens
gcaaaacactgccccgcccccactcctccgcatttacagccatggcatttatagccaggtagcactagagcagcagtggactataagggaccatgtggaaagggacaagtggaatcacaagcccctggtgccaacaaatgattgaccattgttggtactagagctttgacccctgaaagaatccatttgcctgtgcaccatg

SEQ ID NO: 81229 - DNA, 271 bp, Homo sapiens
gagattcatttatgtagaacgtggctgaaatgatgtaaatctacagtttccacctcaaactcagcagatgcaaagaatttcaacaactcccctgtgagtgttaagatatcccacagggtagatgagccattattgtaccgagccactgatacttagctccagtgatccttaatcggaaactgctttctcttttaagggtaacatcatcttcctaagattccattgtttgttattctcaggagcaaacagctgggagtggcggctcacacct

SEQ ID NO: 81230 - DNA, 945 bp, Homo sapiens
tagagacagggtcttgctctgtcacccaggctggagtggagtggtgtgttcatagctcactgtaaccttgaactcctgggctgaagccatcctcctgcctcagccttccgagtagccaggaccatagtcatgcaccacacccctggctaattttttaaaaattttttgtagagaagaggtcttgatgtgttgcccaggctggtcttgaactcctggactcaagtgatcctcctgcctcagcctgccaaagtgctgggattacaggagtgagccatcatgcccagtctcattctgctttcatctgaggggcagaaacaggagactcaagaggagaagccggggctcgagggctggcaaagccagcgtcgctcttccaggtcctgtgcagcatttcagatggaacccttggaagcccactgaccacatgtgtgacctggggaaggcccatcttttggaaactttgtatcacctgctttgcccattccttcaagaaacgctgatttgttgaaggaacataatttgttccactatgtacagggctttcttctgaacttagaaaaccaaaaacaaaaccacctcaaaaactgtgcatgcatcaagattcaaagcccagatgcattgcaggatgtttgtttaatttgcaaaaccttcaccatgaggtttctttcagtaattagctcccaagtgcatatgaaaaatattatagataaaaacgtttgtggaaggcaaaaaaaagctttaactgaatagatttagttatacttgcatgataaaaagtgtccaaaatgtttctagttttctccttgcctttcatatttgtcagtgaatttaatgacaaacatcaattacctgaaaaatgtccttgcggtaggtggtagcattgaattgtattacagatcttattgaaggggtgaatacttaatatactaacgttcacatttacaa

SEQ ID NO: 81231 - DNA, 745 bp, Homo sapiens
cgtaaggatattggggtgagaagcaagtgtctcggagtgacccatcccctgccctatttcgtttgcctcccttttttgtaagttctccaaggatcagcactcccttgaccaatcacaagcatcccagtcccaggtgacctaacccactcaggccccacccctgcagtccctagagctggtggtcttcctacagacccccttctacacttgcgtggcatcagcaacgcgtgctgcacctgcagtgcagaggtctcgggttccagcaggcaggctgagcactgagggcaggttgcttgtctcctggagggagccgttgaggagctgtcacttcgctggagcatgtattggcctcagattccctcccctagcgggctccatgcataattttaaaaagccaattgcaggagtaggaattcagttcaattgtggggaaggtagaacccagcttttaggtagtgtgggtttataattctataggatgggcttattcagaaataaattcatgtgactctgagtgaagaattgagtatctaataataaatttttcttccagttatgcaaccattagtgctgtgtttgtgttttggccaacacgctttttaagctaggcctcagtttcctgagtgcaaaaatgagtggcagaaatgaactgaggtctgaggcttctgtctgtcctggcatgctgtggttctgggacgctagtggtgccagggcaccgtttccccacacttttccataaagtctt

SEQ ID NO: 81232 - DNA, 683 bp, Homo sapiens
cgtgagctgagactgtgccactacactccagcccggggtgacagagcaagactccatctcaaaaaaaaaagaaaagaaaacgaaagaaaaagaaaaaagaaaggcagattattctaattgaatgaataagaggctgagagtcaatacctagttccaacgcccttttgtttttgcagggtttttattggccactaactagctatgcaagctgattttaggcaagtttcatagcctctctgtgcctaaaattccttcacctgcaaaatggggataagaatgcctgcctacttacctcacagtgctgttatgagaattaattgttgtaatagttgtgactaaccattggcggggagaattctaagtactataccaatacaaatttcagcattttttcatatactgaaccctagcaaaaaaaaaaaaaattctgatgaacatcagattcaacctgtcattttacccggatgttgtgatgagccagcacttgtcccaggaggacgttgaatcagggacacgaaatctcagcacacagagattctagcatcattccaatagattggaccctgatttctgtttctgacatcctgttttttgtttgtgcgtgtttgggtccctggtcttttacccaaatcaaatgaaaagtgttgctcagaggcagaataaaaatggttttaagtaagcct

SEQ ID NO: 81233 - DNA, 559 bp, Homo sapiens
aaacattaattacctaattcattcattcattcattcattcattcatacatgatctggtcattggtcaggtttgttctaaaaaccatgctggaaaaaatggaacagaaacgaactgccaagggtggaccaaagatacagagccttgaaagccgggtgaaggtattggaacttgttggccaacctgccaaccaacctgcccatttactctgtccttccacacccacgcctgagcatcctctctgcacaacctcccacctattcattacagctgcgattttcaaccttgggcctcatcggaagcacctgcagggcatgttgaaacacagctggctgggctccacggcagcctctgactcagcagcctggggtggagcctggtaatttgcatttctaataagttccccggtgatgctaatgctgctcgtccagggttcacaccttgggagccaccgcgtactggaatggtgacagcgtctcaggtgactgtgcctgccagttcacactatatttcctaacagccctgtgaatttgggatgattggtgcccctctgtagatggc

SEQ ID NO: 81234 - DNA, 413 bp, Homo sapiens
ctagcctcggttatggtctgtgctggaagggttgtgaaacctgattagcaatggtcttgaaccccatgccagtttgatctttgtctagataatggggaaagattgaaggtttttgaatacaacaagattgtcatgactttatttttcttgtgctttagaccagcccttcttaagcgctgcagtaaatatttatattttttcctttcaatactgccatcatattttgtgaagaaactttcattgatgtttctcttgcttaaagtaaaacaaaaaatgcccactagagggtactctcacccccaaatgtgcttctgtaaaaccatctacaaaccatctactaagctggaaagcagttttcagttgtatgaagactattatttaaagtcttttcttgcctagaaaagaaacacaca

SEQ ID NO: 81235 - DNA, 702 bp, Homo sapiens
ctacttgtaaaacaccagaaataagaaataggtactgtctctgctcctgaggaacacagaaactagcttgctgggtaagtatactataagtgtactaagtgagacggttgaagcatgatcagaatgccataggggcaccaagaagagagaaattccgactggcatttgatatgggcctctaaggataaatagcatttgtattgaggtaggatggctgttgtatggaatgacattcaagtgtaagaatgcagtatatagaataaagaagaatccagtgtggtagagctaaaagaaagttgttgaggttaaggctggaagggttgtgaaacctgattagcaatggtcttgaaccccatgccagtttgatctttgtctagataatggggaaagattgaaggtttttgaatacaacaagattgtcatgactttatttttcttgtgctttagaccagcccttcttaagcgctgcagtaaatatttatattttttcctttcaatactgccatcatattttgtgaagaaactttcattgatgtttctcttgcttaaagtaaaacaaaaaatgcccactagagggtactctcacccccaaatgtgcttctgtaaaaccatctacaaaccatctactaagctggaaagcagttttcagttgtatgaagactattatttaaagtcttttcttgcctagaaaagaaacacaca

SEQ ID NO: 81236 - DNA, 668 bp, Homo sapiens
agattcggcactagggggaatgttatcattggagctaaaatttgaagaacaagtaggagtagggcaagtagaatatcttgggcagaaagaacgttagcattataccaataaaagtagtcagatattaacaaactaagttaaagaaaaataaagcaaaaggcagcagctaactgtattctgtgaagagacatgtttaaaacaaagataggagaaggttgaaaggaaaagctctatcatgcaaacacaaccaaaagagctggtacggctacaaaaattagacttttaagcaaaaaccatattattagagatagaggaaacttaataatggtaaatatacctaataacatagtccttgaaatatataaatcatatggagaatttaacaactgtatagtcttagtgggcagtcttaacatgtctctctgatagaccagtagacaaaactcagtaaagctatagaagatgtaggtacattagcagatgtaactaatggacatacgtagaccactgcaaccaccaataacaaaatgtatattctttttcagtatccctggaatgtttacaaaaattgactattttggacaataaagtgtaaatacattttaaaaggatgaagtgatacaaagtgtattttctgaccacaaagtccttattctagaaattaatac

SEQ ID NO: 81237 - DNA, 1508 bp, Homo sapiens
  misc_feature (1501)..(1508): n is a, c, g, or t
cggacgcgtgggtcgacccacgcctccgcacggctgcgagaagacgatacaaggggaggactggctttgtgctcagtatttggcttttgccactacagactccctcagttgtattgtgaaaattctgcagcaccgttaatgtgtacctggatgatgcttttactacatcttcaccttcttcatgtcacccatgcacttcccctccctagtgctcactccaaattcaaggaaagaagaaaggcaaacctctatccctgtccgtgaacaagtgggtctattcagaaaggttatccactgccccagattgaatgagaagctgagtctgtcttaactttacagaaattcagctgcacaaacttgcagttgccttcccttgaaacaccttctatcctaatagtcccataaatgcaggtaaaaatgaaaatccatattcttgaagggacagcttctttggtatgaactcagccagtgagctgtgtccatttcctccataattctggatatcacctatctttttagcaccaagtatttattctcactagcagtagacagacttaaccagtctctaccacgacccagtagactctgacaacagactcttcctttaaggtgtcaacaactgacttactaggcaggactgccatccttagcatcagcccagttttggttaccagggactatatcttttgttccaggagagagtagaaagaaaaggagagatcccatccttgggtcatagacccattttcattgccattatctgtaagtatgtgcactgcatggaggacagccctaatagtctcccctctgctgccactgcctgattctccactctgtccccacttgccagtgaagtttggatttatcagccacttgtggcccattacagagctgacccaaggtggtgtcaccaatgcctcagcagggtggagtgcagttcagagcttataaatagctggcagggcatgaggagatgattttcttgcatgtgcaattctctaggggccatcaggaaacagagtttaaagtaccctttgattactgtcagaactgtcagcatttgcagttttccccgagcagtaattggccagctcccttctatcagtagccagtgttaactagtttaccaaatgctgtaaacaattgccctgaatgaaatagctgtcagtggagctctaagatctcctttagagggcacagtgaggtgggctgttgggatggccgtaggcaggggagaggaagaaggccactgatgagactgctgacctcctcagaatgttgacctcttctagagagactgcctcccagtgtttaagtggctcattgctccttctgactctgtaaaatggctctggaggacagctcacaggaattctgattgctgaggtgggtgattgagagctgttcaccatgtgtgcagcctgtgctccccttctatggatatgtgtgcaatttttgtatgtatttttttagctgtatattacagtgtttatgttgcaannnnnnnn

SEQ ID NO: 81238 - DNA, 2526 bp, Homo sapiens
  misc_feature (2519)..(2526): n is a, c, g, or t
agagcaaagctaaagaatctcagcagtattatcacagcttggctgtccggcagagtctggctgtccattttaacattcagcaggactgtggtcatttccttgctgaagtccctaaccgtctgcttccctgggaggatccagatgaccctgaaaaggatgaggatgacatggaagagactgaagaagacgccaaaggagaaacggatgggaaaaacccaaagccctgttctgaagcagcatcatcccagaaagagaatcagggagtcatgagcaagaagcagaggagccacgttgtggtcatcaccagggaggttccatgtcttactgtggctgattttgtgcgagactctctggcccagcatgggaaaagccctgatttgtatgagaggcaggtgtgtctgctgctcttacagctatgctctggtcttgagcacctcaaaccctaccatgtcactcactgcgatctacgcctagagaacctgctacttgtccactaccagcctggggggactgcccaaggctttgggcctgcagagcccagccccacctcatcttatcccactaggcttatagtgagcaacttctctcaggccaagcagaagagccatctggtggaccccgagatcctccgggaccagtctcgccttgccccagagatcataacagctacccagtataaaaagtgtgatgagttccagacaggcatcctcatctatgagatgctgcacctacccaacccctttgatgagaacccagagctgaaggagagggaatacacacgagcagacctgcctcgcatcccattccgctccccctactcccggggtctgcagcagctggccagctgcctcctgaatcccaacccttctgagcggatcctcatttcagacgccaaaggcatcctccagtgtctgctctggggcccccgcgaagatctcttccagactttcaccgcctgccctagcctagtacagaggaacaccctgctccaaaactggctagacatcaagcgaacactgctcatgatcaagtttgctgagaagtccctggacagggaaggtggaatcagccttgaggactggctttgtgctcagtatttggcttttgccactacagactccctcagttgtattgtgaaaattctgcagcaccgttaatgtgtacctggatgatgcttttactacatcttcaccttcttcatgtcacccatgcacttcccctccctagtgctcactccaaattcaaggaaagaagaaaggcaaacctctatccctgtccgtgaacaagtgggtctattcagaaaggttatccactgccccagattgaatgagaagctgagtctgtcttaactttacagaaattcagctgcacaaacttgcagttgccttcccttgaaacaccttctatcctaatagtcccataaatgcaggtaaaaatgaaaatccatattcttgaagggacagcttctttggtatgaactcagccagtgagctgtgtccatttcctccataattctggatatcacctatctttttagcaccaagtatttattctcactagcagtagacagacttaaccagtctctaccacgacccagtagactctgacaacagactcttcctttaaggtgtcaacaactgacttactaggcaggactgccatccttagcatcagcccagttttggttaccagggactatatcttttgttccaggagagagtagaaagaaaaggagagatcccatccttgggtcatagacccattttcattgccattatctgtaagtatgtgcactgcatggaggacagccctaatagtctcccctctgctgccactgcctgattctccactctgtccccacttgccagtgaagtttggatttatcagccacttgtggcccattacagagctgacccaaggtggtgtcaccaatgcctcagcagggtggagtgcagttcagagcttataaatagctggcagggcatgaggagatgattttcttgcatgtgcaattctctaggggccatcaggaaacagagtttaaagtaccctttgattactgtcagaactgtcagcatttgcagttttccccgagcagtaattggccagctcccttctatcagtagccagtgttaactagtttaccaaatgctgtaaacaattgccctgaatgaaatagctgtcagtggagctctaagatctcctttagagggcacagtgaggtgggctgttgggatggccgtaggcaggggagaggaagaaggccactgatgagactgctgacctcctcagaatgttgacctcttctagagagactgcctcccagtgtttaagtggctcattgctccttctgactctgtaaaatggctctggaggacagctcacaggaattctgattgctgaggtgggtgattgagagctgttcaccatgtgtgcagcctgtgctccccttctatggatatgtgtgcaatttttgtatgtatttttttagctgtatattacagtgtttatgttgcaannnnnnnn

SEQ ID NO: 81239 - DNA, 397 bp, Homo sapiens
ggtcaacacagacctggagacctgggctctggcctgctctgctccctggagaatctgggcacagatggtgtgggcccccacatgctgccttctgcgtgtccctggttgggcccatgctggccatcaccccagcttgggttcagtctaccatattctactagctttccttggtgaccacgttgattggctgtctcgagccagccagtgtcaggaatgcagcaggttccaccctctgttcctgctagaacgcttttcctgaccccagcagaacacatggctcagggtgggcaccagccaagctgggggctgacttagacagtccctgactctggtgagaagaggggagtggccatgctgagctttgtgtgttctccctggcactggggctgtgggggac

SEQ ID NO: 81240 - DNA, 363 bp, Homo sapiens
ctcaacaaagtttggattttctccacgatgactccttgggtgaatttttaatcaagttatttcaaccatttttctcatatatttcgtgcatccctattctggtattcagtgaatacatgggagaggtatgttattctcagctcccacagcccataagtcggggaaccaggacttcattcccctctgctctaactcagactgtgaggtcattgagggcaagactgatgaattgttcctcttcctatcactggtgccaagcacagtagttggcataaagaaggtactcaataaagaggggtgaattaatgaaagacagagaagaggaacctggggaagaggtggcataaagtgaaggtacaaaca

SEQ ID NO: 81241 - DNA, 412 bp, Homo sapiens
aaaattagctgagtgtggtggcaggcacctgtagtcccagctactcaggaggctgaggcaggagaatggtgtgaacctgggaggcagagcttgcagtgagccgagatcgcgccactgcactccagcctggctgacagagcgagactccgtctcaaaaaaaaaaaaaaaaaaaatctgtcccaaggtgaacacctttttaatattctagaaaatcttttgaggtttaaaagcagtctgtccaagtaatttgttcagaacctgtcaaaatagtattacactacttttaaagtttttacagaatttcccctgtggacacaaaggttattacaacagcaaagttttctattgtattgtttttagcctataattacttaaaaatcattaaaactctgtgcatatgaacatttgattt

SEQ ID NO: 81242 - DNA, 1705 bp, Homo sapiens
  misc_feature (139)..(139): n is a, c, g, or t
  misc_feature (144)..(144): n is a, c, g, or t
  misc_feature (1249)..(1249): n is a, c, g, or t
ggagccacagtgaaagtcaagaatgtcagtgattccacatttaatatctacatttttgcagggcagttactcttttgtagtataacattgagctgatagcacatagtgtagacaagtgaatacaggattctctgggttntattnccagaagtctggaggtcatttggatatttgtgggcccttggcttcactctgacttgtgtgacacataaaaattgtgatgaaatgtcctatagatgtcctgcaggtcttaaaagaacctttccaaactatgaaacagcccagcagcactgagttagaggtaaattctgaacccttgaacactaaaactattctaactgcacatagaattggcaagtagcattctatgtctatgaacagtatgtcttttctatataacagagaaaatctttttaagcaaactactcagtttaaaacctaattcttctcataatctcagtacttttgaatgaagacatatcaatgcaacagtacactcttattcaggcatttgaaagaaagaattcgagatctagtttgtatcagatattataaattagtatggtttagtctttgtcatgaaattctacttaatttttggactataggtttaagaatgtaagcagaagttctgcaccaatcagaataagctacattatgcttgagtgacaactactgtaatgacaaaatatcagtggcttaatacaatggtttttctctcatacttgttcataaagagtcagcaaggaccctgctcattatggtccctcagggacccaggttgttggaagctccaccattttagatagctcccttcaaagtcagccatctttgcagtcatgtcccccaacagctgcaaaatttgctctgatgctcaagaattgagcatcggcagttaaatgcttcaacatgaaagtgacacctgccactcccactcacatcccattggccagaactagtcacatggccagacctaacttcagaaggttggagaattgtaatcctccatgtacccaaaaagtagagaagccagatactgagaaacatcaataatggctaacagaaatccattctaccattccctttgcctaaagtgaaaagatgagtactttcatcaatttgtaaactgtacttttgaagtaaatcctggtagcttgcatgggggctggatttccagaaagccatatgtaatttgggaatgacattcacttaagctcatagaatatcattatttgatgtaaaatgcccncatttgcaatacaggaccaaaatgcactaaccacaaaattccactccacaagggtctgggttctaatttcttcattctttaaatgaggcattctatgatttggaatggaagcccagttgtagtcgtaagaattttacttaattcaagaattattctcactgaatatgtgccagttctgaaaggaatgcaaagtcaaattttgcatcttctttgctcaagggcctttagatgtaacaacacagacatgatacaaggctgacaatgacattatgatttaaatatgttaaacaacttattaaattgtgaatcaacaaaaaattatgttctttattttatggttttgcatagtcctgactcactgcctacatacccctcttgttcctcagttcttatccctgatttcttacaggatggcctaagacagctgtagatgtttttatttagcaaaaaaaaaaa

SEQ ID NO: 81243 - DNA, 648 bp, Homo sapiens
taaaaatgggttgtttgtctctttagtattaagttgtgagtttctttatatacagattctatatcagatatatgttttgcagatatttttttcccaatctgtagctggtgttttcattttcttgttaaaattcgtattctggagaaatttttagacttacataaacatttaaaaattgtatagggagttaccatataccctgtactctgctcttccactaatgttaaaaatcttaaaaaccgtggtatagttatcaaaaccaggaaatcaatattgatgcaatcccattaactacagaccttatttgaatttcaccaatttttgactaatgtcttttaaatttttattttctcatttaaatagctaaagtttttaaattttagtttatattttatgatgcttatatttttaaatgactaaaaaaacaaaagaaaaatattttgtgacatgaaaatcgtgaagtcgtttagttttttagttttataaactaaacaggttatttcataacctgttcaagaaatatttgcctaaccttaggtcactcagaatttcttaatatgttttcttctagaagttttaaagttttagcccttacatttaaatttgcgatccattttgagttagtttttgtatatggtgtgatataag

SEQ ID NO: 81244 - DNA, 419 bp, Homo sapiens
gacaaactagacaaaagcagcaaaataaacccaggaaataaaaatgaattataatacataaaatgtaaaatttatgaagaaacctatgatctggtcttgggtttattcacacatatatgcaatataaattagtctactagtttaacttcatatgaaaagagagtataaagaaattaaaagactgaatgcggtggctcatgcctgtaatctccgcatttgggaggccgaggcaggatcactcgagcccaggagttttagaccagcctgagcaatatagtgagaacttgtctctacaaattaaaacaaacaaacaaaaacaacaacaacaaattagctagtcattggagggtgagcatgtggtccgtactactcgtgaagctgaggtgagaggattacttgagcccaggaagtcgagactg

SEQ ID NO: 81245 - DNA, 276 bp, Homo sapiens
taggatattcagcaattctttactggatgtgatcagcaaagacaagacatctgcagctgatgggatcacctagatttggaggttggggaacagggaagatctaaacacccttgttttcttggcctctttggtctcagccacatggaatcagattatttgactaggactattaatgcataagaagggagaaacacaaaaaggtgatttcttgaggtttcagcttaccttgtcaatgattctgcaactgtgtgccatgaattcttagtcctgcaacat

SEQ ID NO: 81246 - DNA, 707 bp, Homo sapiens
gctggagtgcagtggcgcgatctcagctcactgcaagctccacctcctgggttcacaccattctcctgcctcagcctcctgagtagctgggactacaggcacccgccaccatgcccagctaatttttttgtatttttagtagagacagggtttcaccatgttagccaggatggtctcgatctcctgaccttgtgatctgccagcctcgggctcccaaagtgctgcgattacaggacattgccaaagattttcccaggggcgaggagtctctggagacgctggaggagcagtctgcgggtgtcattcggaacacctctcctttgggtgcagagaagatcaccggagaactggaagagatgaggaaagttctggagaagctgcgcgccctctgggaggaggaggaggagcggctgcggggcctgctccggtccaggggagcctgggagcagcagattaagcagctggaggctgagctcagtgagttcaggatggtcctgcagaggctggcccaggagggcctgcagcctgcggcgaaagcggggaccgaggacgagctggtggcacactggagacgctactcggcaacacgggcggcgctggcctcggaggagccccgggtggaccggctgcaagcccagctgaaggagctcatcgtcttccctcacaacctgaagccactctctgatagtgtcatcgctaccatccag

SEQ ID NO: 81247 - DNA, 369 bp, Homo sapiens
tcttcaggcttattattttaaatgttttagtcctaacaacttgaagtcacgttgctcttaattcagtatcctaattctgtcatacccttgttcattgagtacctattacatgtcatacaatattgtttttaatggtgattcctcatctgaaccacaatatacagaaaatgatttgagtgactgttttctctattctcccatcttagatgcataaaagtgaagttactgtattatatacattgggtgccttaaggtagcaattttcaaaccattttgtttcagaactactttatacatttaaaaattaatgaagacccccaaagagctttagcttatatggcttaaaggtattaatatttaccatattag

SEQ ID NO: 81248 - DNA, 846 bp, Homo sapiens
gagacagaatctcacccaggctggagtgcagtgatgccatcttggctccctgcaacttctgcctcctgagttcaagggattctcatgccttagcctcctgagcagctgggactacaggcatacacccccagctaattttttgtagttttagtagagaccggatttcactgtgttggctaggctggtcttgaactcctggcctcaagtgatccgtccacctcggcctcccaaagcactggggttacaggcatgagccactgtgtccagtcaatacttttcaattttaattcaagttgaagctacatgataccaaagctcccaatgaattcacgtcagtgcggggaaaaaaaaaattcagtcgatttaagataaaaagatattcaagtaggcaaataggttttttaccattttttcctttttgaatgttctaacattgtttagttaatcaactgataatcatcatttataggatccgagtttcttacagcctaacagaaatgtgaaaaggatatttatagcgaaacattattttcccaactacaagagaaaatcaaatgaagtaaacaaaatttatgaaagtttgctgtgcttaatatgaattctccattggtctgagagatgatgctcttctttctttgcacagagtgaaagctagggtagaatttgggcaggaaataaagaatagagcaagatactggaacttgggggaaaaatctaactcctcacggctgaagtcttcgtaattctgcatcagtgccacagtctaccagaaaccaggccccctagtggattaaaagagttaaggactgaatgccacatgagaatgatttcaacactgaggtgtag

SEQ ID NO: 81249 - DNA, 261 bp, Homo sapiens
gcctgcctcagcctcccaagtagctggaattacaggttggcaccaccatacccgccttatttttgtatttttagtagagatgggttttcaccgtattggccaggctagtccctaactcctgacctcaagtgatcggcccacatcggcctcccagagtgttggaattataggtgtgagccactgtgcctggcccaaacaattttaagatatgttttgatataatgtagcttgctaaagctgtaagacccctatgaatattcc

SEQ ID NO: 81250 - DNA, 277 bp, Homo sapiens
ccgggcagtgcagcacggtaagtaaggcgcctacagggtagcagcagccacggggaagtagagatggaagcagacctgttcctccaggagtttgggtcacaaacaagataggcaggtgtgggctccccctcctcctgaggcaccgactgcccctcctgagagttcagcgtcactcaggtgcctcattgtcctgggtcctcctgctgggaatgctcagatcagacctcaggtctcctagggccttccagtggacgccgcaggcaagtgtccagggcac

SEQ ID NO: 81251 - DNA, 557 bp, Homo sapiens
cacgctccaggcctggagagccgccccgcctctgcaggagctgcttctcctccctccctgctgctccaacttggggctggggtctccaggcagtgtcacctctctggcccttccaaatctcatctcccaccctctgaagccaagagggaccttatgagaattgttctaaccttcagtaaagtgtcctccccattccggtatccgtgagatctgctaggctggaaggttttgtgtccccccgacacacacacacacacaccctcccctgggtcccctgcttgatgagcgctggaatcaggacgctgtagttcaactctgaacagagatccaggcagcaggagtgactgcgacagggcagtgccgggcaggaccccatcgatgggcgagcggagagcaggcacggagctgagcaacctggggaaataaagcgagaggcagagacacagggagagggagagaggacctggagtgagcaggagcgagcgggaggcagagaggagagccgcacttcctaagacagctgcaagtgacagctaaactgagtgccagcgttgggg

SEQ ID NO: 81252 - DNA, 779 bp, Homo sapiens
aagtggaaatgatttgattacatggggaaagcgctttttttctttcaaataatgtaggcagggcctgagatggaaaaatgtacaataaaataaatctattttcttacaaagaataataaaaatgcccctatcaaataacttgtcaataaaatgaggattattcttgaaaatttgactagggttctaccaaagtgtaaggaggcagccatgatgacttctcatttattggcatgttcagggaaatttttggtttctataaaacttcactgtgtcagaactcacaaccatgaatctgttgtctaagagaaaggactgtgtctcaaaatgagtgaatagtattttcttgacatctttaaggcaaagcaccccaatatctgactttatagtcattgtcaataagtgtaggctggtttttatccagtgttatgaaatttacatggaccagggacaacaaagagaccaatctgagtgcaaaacttggagggcttggtgacctggtgaaaatatttgtaaggttaccataaatgccatgttcaaaagattgttatctgtaattttatacgcctcctccagtactgaccttctttctaacaaatctttagaagagaaggacaaatgttaagagttaaatgatggcaatataccccatcctgaaattgacccaggagcaatctatccctggaaatacatgtttaaacaatagatgtccccagacaaaccaagggaagccttggactggtatgggagctatgttatgacttgcattccttcaacaggga

SEQ ID NO: 81253 - DNA, 877 bp, Homo sapiens
gtggtggtggagctaatgacatgtgtgcagaaactcttctgaatgggacttcccctgatcctgtttttacctgatcttcatgctcaatagaaaaagcctcagctttggaatcagcttcccagtgaacaccgagagttgagtttagcaactgtttggactggccatgtaacagggccgtccaggtagcatggcatggtactggaacactatgtcttctctctgacctctcggaatatctctgtgattcaatgtgttggcccattggaggccctggactggttaaaacctggaggtttgagaaacccctgatcttctccatactcttcacaagggcaatggctggccaagattacaaattagtgactgttgaggctggaatctgtaccgaggtcatgggaaccccctgcactgccccttctaatcaccctcctgcttggaccctgggagtatgacaaagagtcagataagacaactgaggctgaagatcacacaaccagtaaatggaacagccagaaatcaaatgttatatattggccctgaagtggggataaagcagctaaaagaaagtgtactttacattaaattttaaggtatccaaaagcaaatcaataagccatactctagttacattaagatattttcacaagtgctaggttaagtaatataaaattaccatttttgtaggtcaaaagtaatggaatatcatgcttgtatatggtttgatctaatatatatcattatcaggttctactaatacagagttttctgcctttacttaaccatcacaataaactaaggacttccaagctagtaagaataatgacacagataataattagaaaagtattcataacattatcaacaaacacttctacca

SEQ ID NO: 81254 - DNA, 856 bp, Homo sapiens
gggatgagcaaataggacctacctcccaggacacctgggaggatgaaatgagatcacgtgtgtgaagctcttagcatggcgtgggggacacagcaagtgcaggggacgcagcaacagtgtggcggctgctacatcacggaggctgtaaggccagactccttgtccccagtgcccagctaggtcccttgcccccccggctctgttgtctttagtggctcttcctcctcactcactcctctgtgcagtcacacagcccaacccagctgctgcactcacctgctgcatgaccctgggcaaggtgcttactttccttacgtctgcatttcctgatttagaaaacagggtaaagctgccctgcctgcatgcttccaaggctctggcacacacacaaggatgtagcccagcccttcctccaaggagttccatgacaggaaagacagaaggggaaagaaatacttgcaaattcggtgtgagctatgacagaggtgcacggacattcagcaggaggcaggcaatggcatcacgggctcagagtacagtgagggtgaaagaagatgattccacacataatagttgctcagtaaacatcttttcccttctccagccttactctttccatatagcctaactttttagactcagctgctttccacctcagaaccccaatctctgtcctttctgctgagcctgcaaaatctggaaggagggatagaagacgggccccttggggagcccctcctatcatcaccaaccttagttaacatttgctgtttactgtttccaggcactgggcaggtgttctgcatacattaaaatctaattgaatcctcacaacagctccacggaacagttgtca

SEQ ID NO: 81255 - DNA, 207 bp, Homo sapiens
aactttttaaaggcatttaattttatttggataatcacaagttatgggtcatgttgtcctaacttttatgttccttttaaaaattgaacagatattgaaactggaaagaggatttcgttatctgatccatttatggtcagagcaagattgtttcttgctatatatttttggatttttaatttttgtcatcaactgaggatggttata

SEQ ID NO: 81256 - DNA, 282 bp, Homo sapiens
gtgagagcagctcccattgtgatggcattattgtggtgccagctaacccaacccaccgagcttctcacgtgccagacactgttcttcagagcactttccacacagcggctccctaaattctcaggacaaggttgtgaagttggtactgtcgtcacgcccattttacagatgggggaccgagaggttcaataactgcccagggatcctccccgagggaggctggtgatgggcttcataattcttgttcattgtgaccactgtggtgatgatgatggcagtgat

SEQ ID NO: 81257 - DNA, 325 bp, Homo sapiens
ttctatactaagcaggctttgaaaattaaaagcacagaagtatatgttcttgtattatatagtcacactaataaaagcaataaaacatatccaggggttgcctgacatgaacaattttataagcctggtatcgatccccagattcttttcaagtgaggttgctttgcagtaacctattcccttgtgcattttctatcactgcactcctaagccttgtgctaaatataggagagcttggaatttcacgcattgtgacaatttattgcaacttttgttctattgtcaaagtttattatccagtcagaattaacaccagtgcacaagg

SEQ ID NO: 81258 - DNA, 335 bp, Homo sapiens
tcacagggcttttactactgctttttgttcactgctcctaaaatgtgttttcctgtcatcatcaccaagttaaatcctacataaacttctgatcttattcaagaattacctcctaaatgaagtattctgactcctgcaacaaatcccccaattttaggctcttgttgcacaacgtacctttaacacttgtcatagtcacaattttatagtgtgactaatgtgtccctccccaatcagatcataaagtccgtatgaacacgtctggttttgttcatctttgatgtcccagcactcagcacactgccaggcacacagcatgcactcaacaaatattt

SEQ ID NO: 81259 - DNA, 776 bp, Homo sapiens
gctgtcaggaagccaggtgcgtcctcactccccagccctaaaatccaaagaaagaagagattgtttgagacgatctgaagaaaggtcaggtcctaacagatccacgggaccttctttttcaccttccttgtcttgggttctggagcacgggcgctgaatcagctgaatgcggcctgggcatctggaagtggtcctgagggacacctcgcggtgcagcccccgggacgacccaggacaccctggacaccctggacacccaggccgagagccgggacccgcccacgcctcctcactgctgctcgagggtaggcaggagcacgcggaccccgtgggggctgaagcggggctctgctgcccgccctgcgcaagctcccggctctggttgctggtccacaaaatcgggaggctgaattagccggtcgggtggcccccagccttatagcttcgaattctgtgatcctattttagacccagacttgtccgcgaagggaaatgaagaggcgcggaaggcttggagcgtgaaccaaaaaacaatgggtggggatcgtctaaccagctcccttccctagaagggcggaaacggctttcgaagcatccgcgattctctttattgaatcttgagtgacacctagtggcccatccgcctcaccgtcacggcgatgctggtttcactgggcttttcagaaggcgtgctggcctgcccatggttctcggctaaaagactttggagcgtagggtgccgatgaagtttcctgggaccttccggaagcacttgc

SEQ ID NO: 81260 - DNA, 834 bp, Homo sapiens
atggcatcggttctcctcactctccagcctgttggctcatcctgtggattttggacttgccagttccaacatggttcaagccaattccttatcacaaatctctgtctgtatatcagcacatcctgtgggttcagcttctcttgagaacactgaccaatccaatcaccgttactcccgatgacttgtaggtgaagccccttaaggaaaatttctttcacaaatgagagctagggaaagatttactcttcctgagcagctaaagtattttctccaatggccacgagaaccttaaacctttccttctttccacgctcccattggccgccaggaacttgcagcttggctacagcaatcatgaaggacctgactgggctcagcacatgtgcccaggccacccaggtagaggtggagggcatgggattcaagcccaggccatcgttggctctgaacatatacctgaaacaacctccctaccaggaaggaggctgccctgcctggagtgaagagtgcatggagcagtctcagccgacccaggtgggatgcgtaacatggccgagaaatccacccatgctgctgagagctactgcgccatggggtcatgtgtcacctaactgacttagcccagcctgactgatcccccgtgtgtgaccagacatcagcacattcagaggacctcatactgagaattggtggacctttcagaatggacatgaccactcaaagtagggacattactcgctatttgatggcccatgtgggatcaaaggccactggggttccctcaaggcacagcacacttagaatcccataagtcctcagttctaaggcatgtat

SEQ ID NO: 81261 - DNA, 378 bp, Homo sapiens
aaggtttttggtttgtgtatctgaaagtgcttagtatatatgaggaaccacaaaccaagtgtatgagtttctaaatatttgaattattaagggatttttcattcattttctagagagcaaatttatctaggcatttataacattttaatttagacagtgccttttcagtttttatctttggtgaagcaaaacatgaatttaatctttagtaacaaatcccatatctatcttcctatttaaagactaattgtatttgtcttttcacattaattttgaaaaaatgacggcttatgtgttataaaccacatgtagttctcatgttctgaattatcatttaattttggtcttactggaatatttctagataacttttttttt

SEQ ID NO: 81262 - DNA, 424 bp, Homo sapiens
actttggcaatcctaaaacctttaaccaggaacaactctgtgaaatgagaactgacagtgtggccttgacctggaccgagcgaaagtccagtgactggcaaagaaagccattcttttggatcacaggtccttctcccctgttggcatgtgtagaaacactttgaaaggatctcaaacacctagtcagttggacttaatttccaaggaagcatcgatatttctaaccattaccttaataaaccacttgggttataagaaattcagaaatcattatatgctcaagcccaaagaaataagtttcttaggtgaaagaaaaatatactttttctttatatctctcttctagtctgctcgttgtttcatttatgtgaaactgggtgaagaatgcactgcatgtatttaccctaaactgttggtagtggat

SEQ ID NO: 81263 - DNA, 338 bp, Homo sapiens
aaactagaaattaataaaatgtggcatctaaaacattttttacaaagggagccattggggacttgaaactgggagactacttgatcatatttaatgttctgaaaagatcactctagctgctgtggattatgggggaagggtagaaacttgaaggccacctcgaagtttatggcagtgatcctgaggagagatgatggtaactgggactggaatagcagtaatgggtggggttagattcaggatattttgaaggtgacagtacttgctgatagatcaaatatgtcaagaaaacaggagacaaatcaagggttgctagtcaatttctaggcaatttgata

SEQ ID NO: 81264 - DNA, 405 bp, Homo sapiens
ctccaaggagtgcggttttattgatccacagctctgctaggccctggctgtgtgttcctcaaatacagatgcagttagctttgcaggggattggaagtggaggtctgagttccactcaggaaacgtatggcccgcatcacggcgaggcagggcttctgagggcttggtgaggtgccgggcacagcacagtgagcacacctcctgtgcccccttatttgtgggtgtttctgtaagagaccctgatgctgaggcgtggttggttggttggtgtgatatgggcttcttaagggcacgtgtggatcatgtgtctgcatacagagccgtagcactccatgtggacaggaacgcgtgttccgatatgctctgtggatgtgtgatgcctcagatcatccctctcactgcagt

SEQ ID NO: 81265 - DNA, 434 bp, Homo sapiens
agtgatatgggaagagggggcagaaaggggcccccagggatccataattctcatttttaagggagctcataaatgaatattggcactgccttttcggagggcaatttttcaaaatgtatccaaatttgaagctggcttaacttttgaccttggaatttcactttcaagaagttatcctatagtaacatttccaccaatgtgcaaaaatgtacatacgaatattgtaatgttgcttggtatagtgtaccactggaaaaagataaaagcctaaatacataaattatggtacacccatgcaatagaactctatatagccattaggaatataataactagatatcgttggttgcacaacattgtgaactggaaatgccactgaatttttgctttagaatggttagtcttacattatgtgaatttcacctgaataaaaa

SEQ ID NO: 81266 - DNA, 262 bp, Homo sapiens
tggtccctaaataggagggtttgggggccccgggcccccgcgaaggatccacgattaatgctgagctgggacatcagggtgaactagggttgggcagatagggcacaggtgtgttctagcagaggggcttcttagctctgtggcagtacttttcccacttcatcagatcaggaaatcccaagtagccttatgagttctcacggaaagtacccacatttgcaaacccctggcctgactttgtaccccgtgctggtggagagac

SEQ ID NO: 81267 - DNA, 141 bp, Homo sapiens
gggaaaaacaacatgtcatgcccagaatgataaggtgatatctgaacaggttccccaaacacaaagacgagcatgcatgcactgaagtgagagagtgagaagagaacttcagagagacgtccagtgttgctaaccacagag

SEQ ID NO: 81268 - DNA, 506 bp, Homo sapiens
ttgatgaatattaatcatgtgaatgcagagctgcaaatggaagttattgaattgcagtgcaacactatactgaaaactaaatatgatgatgtgcgaatcccagaattctacaaattcctaggtagtggttaccctaaatataaaaaacattgtgcaaagattctgtgcatgtttggaaatacctatgtttatgagcagctattttctcttatgaaactaagtaaaactaaatattgctcccagttaaaggaaaggtgaattctctgctgcacgttgctatgcaagattcacaacctgatgctgattgatatcttgggccctaagaaaggaatgttagatttcggatttcaaatctgagaagtaataaattacgaaacttgggataattatttctattttcaaattatattttttcaatatgaagtttagagtacaatctctggcattatatatgtttgttaaatcttataccatataaaataaagttggattatacttttggtggt

SEQ ID NO: 81269 - DNA, 425 bp, Homo sapiens
ccataacatttgcaaaaagatcattttgtatttcttaaagagggcctccccacaaaattgtgtgcactttaggtaggatgaacaactgtccctattttagcattaaaagtcccttatctggccaggcacggtggctcacgcctgtaatcccagcactttgggaggccgaggcgggcggatcacgaggccaggagaccgagaccatcctggctaacacggtgaaaccccgtctctacttaaaaaaaaacagaaaacaaaaaacaaaaaaatagcggggcgtggtggctggctcctgtggtcccgggtactagggaggctgaggccggagaatggcgtgaacccgggaggcggggcttgcagtgagccgagatcgcgccactacactccagcctgggagacacagcgagactccgtctcaaaaaaaa

SEQ ID NO: 81270 - DNA, 472 bp, Homo sapiens
aagactcacacacaggaccacagcagcatcactgagccgagctgggggcaagtttcaccagattcgcttacctgatccttgcatcaacctcaatgcagttgtcagccccatttttcagacctggacacggaggcacagggtgctggtgtgacttgcccacagttattagtgtgtgaggtgatgggttttgtcccgtcccagctccaaaggccctgctcttcctcaagctccagaacctctcactgagctcctgcagtgaagtcccccctcagagccctcagcccttcctgctttcaggctccagatgtcagagcacccttgggtgccagccacaagtggccctccagcaggctgagcacccagggggaggctgccctgactcaaccccagcctggggctttgtgctgcacctgagggagtagccgctctgtaaatccttgttgaaagaatgaagtgtcaaaaggttgtgcgt

SEQ ID NO: 81271 - DNA, 387 bp, Homo sapiens
gaagtcataaggcctaaatattaatccagtctgtgacaacgacaaggtgaatacaagccagtctctacttctctgggcctctgttttctgcactttatataaagattgggcaagatggtctaacttaaattttatgattcactaacttgattttgtatggggcagatttttcttcgatgaaatattaacaaataagacactcaaataaatcagcaatggggtgcagatgaggactaccgtttctacagcaaaatatgggtgaactcagtaagtgtagaacacagaagttaatgctgacctcttgcatagcatgtatggatattaaatcatttcctgccttcatttcagggatgaggaagaaacagctgttcctgaactcttttaaga

SEQ ID NO: 81272 - DNA, 473 bp, Homo sapiens
gagcaatgagttccttgggttacaagaggctggatctggctcctggccagtggagacctctcctaggattccagtctctgtcatcaaaagtcattactttttgtacaaatacagcacccctgccctgcccagccctccctggaagcattgcaggattcctgggagcacagtttgctaactccagccctgggaactctacagactcggaggtcagtgcctggaggagaggtcagtgatttctgtttcaggcagattctcaggcttgagctcctcagaaaaagagatcaccatggggaagtgactgggggcttttcagctcccagcttgagaaggaaaaactacgttttcgttgagtccccacctatattttaaatctctttttctttttttctgatggacacttctgctgtttagctttctctgcctcttgctctctctccaaacaaataaaccttttattgacttacttgaaa

SEQ ID NO: 81273 - DNA, 633 bp, Homo sapiens
ccagatatgagaactacaccaaagaaagaagaaaagtcagctggatgtgatgcctcatgcctgtaatcctaccactttgggaggccaacacgggtggatctcttgagcccaggagttcgagactagcctggccaacatggcgaaaccccttctctctttctttttttaaaattttttagttagaaatgaaaaaaagaaagaagtctaggttttctgaaacaagcactgtcttggtgctaccttttttcatgtgtggacacatagaaagcgaggatatttgtacagcaccttgaaacaaataagcaggaggtgatgtcatgagccttagccctgcagggaccagactaggccttctgaagctgaggtggtccttgtccccacaccttgtaacccatttccagcccatgggtgtcagttgggaaattctacacaagatcctagtagatgtaattacatataattcaatggtttttgatgatggggttttaaaatcaagttattcaataggtggggtgcagtggctcacgcctgtaattccagcactttgggaggccgaggagggcagatcacaaggtcgggagttcaagaccagcctgaccaacatggtaaaactccgtctctactaaaaataca

SEQ ID NO: 81274 - DNA, 477 bp, Homo sapiens
ccccggagaaagaatgaagctgctaggggggcctacacggttgcaaccaataaaacctctttccaacagagacagggagcctgaagagtcaccacaatgccccactgccacccctaaggaattcaagttgctcttttgtgcctccttccttaaggcagtgtgtgtgaccactatggtggcccccagctttgctccattgacagaccttcttaatttgccttgtttgaagatgctacttgaggcctgttttttcttaaccaagcattcttattaatgttcttgacattgtttttatgatataaccacatatacttccggaggcaataaggtggaggaggctgataatactataaaaagtattttcatgcagtaaagtgccagccaaaccaaaccctatggagcagaggtatgaactgaaagccaacatacatttaggagtgaatcataagaccaatatgttagtatgttaatggtata

SEQ ID NO: 81275 - DNA, 432 bp, Homo sapiens
ctttgttcacactgtggtcctccacaaagtgctcttgcaaaagagcttgcaagggagcccaccccactgcactgtgtgggtcagccaagcctctgctgtcccaaaactactgcagctgaggtcctggaacaaacaagatgtcaaatccaaacaatgccatcttgtcctacagagtgttcccaaagcagccttttctgtttttacttaaagctttccccaacccaccctctacaaatctcagctagggcctggcttgaaacctgagtgacaagtaccatgttacatctagcattattccctctctcccatgaccagcttgcagtcaagctcctagcaggctctctgtccttcatatgaatacatttttggtaggccccacatcgctaatttgctaggtacctcctgatatatgtcagtctcaatctaggctag

SEQ ID NO: 81276 - DNA, 470 bp, Homo sapiens
tataatatatttgatttggattgacagtgaaagggaaagcagtttgaattttttcaaattattaataggcattaaaataataatttaatgtaagtttttctgtaatgtgccttaataggatttttttaaacttcagtcatcactacaggctccagcacgtgcaaatgaaaatgtgacacatttgtccccacagctgcccacgatgaggttctcaaagtggttagaaaattcagtagccaatgttaacaatttaataatgattaattcatcattccggttgcctgctaaaagaagaaatctaggaaacaaagggtataaatttggaaaagtattttgcattctaatgaagtaaaatggatatttagatacagggaaaatttgaaattatcttcacctgtttcctcagcttatttttatttttattttttgaagtcttcgattttatgtaaaaagttaatttagggacctgg

SEQ ID NO: 81277 - DNA, 425 bp, Homo sapiens
ataatttacctgtgacagactgacatctatacatgacagtgattaaacttcactgaatacccaaaacggtaacttttttttagttcacaatctttgaattagacaactattcctgtttttatttaaaaataacccactttcggccaggcaccgtggctcacgcctgtaatcccagcactttgggaggccgaagctggtggatcacgaggtccggagttggagaccatcctggctaacatggtgaaaccccgtctctactaaaaatacaaaaaattagccgggcgtggtgatacccgcctgtaatcccagctacttgggaggctgaggcaggagaatcgcttgaacccaggaggcggaggttgcagtgagccgagaccgcgccactgcactccagcctgggcaagagagcaagactgcatttaaaa

SEQ ID NO: 81278 - DNA, 791 bp, Homo sapiens
aaagattagaagtagattgaatgaaacactcctgcttgtaggtgcactcccactcatagacagggagcttaagatgtatataagcactagaaaaaatcttctaaccttgagttggtctggtgagttactctgaccttctccttgtaactggttgcagaaaataaactcccttctttcccagtctgcctgcatctcattattggatcaccaggacaagcagccaggcctcattctgtccgggagcaaatctggtaactctcccaggagagctcagcagccagcggctcgcaaagaggtagtctttgggtgacccccagcagctgcctggtatggtttgtcctggggactctcctgaggacctttctggctgcaaagactgcccgtctctctattactgggaaagaatagagattgggagcagttgcactcaaaagccctgcagctagctgtcccaagtaaacaaggctcttggagtaaattggaaactcacacagcatggaaaccacaaccttctggacagactgaaaggatgaatcaaacacgaaaacagtgccaaactgtgccaactaaaatggattcaggtactcagcattgtactgctttgggtaagtgacccctagaagtgggatgaggttaaatccctataaaattataaatgggagaccctttgctgctaatctgtcttgggttacttgggtacctcttaatagaaagccaactattaaacactatgctactcacttgggacaaatacttaatgttttgcataagcttgcttgcaacaggagtat

SEQ ID NO: 81279 - DNA, 368 bp, Homo sapiens
ctcttccagaacatcatataaattgaattatatggtatgtagctttttgaatctgacttacttcacttagtatagtgcatttgaaagtcatctgtgttgatgcaccaataattcattgctttttattgctgagtagtattccattgggaaaataccttggagtgatattgctgggtcatatgatagatggacaggcatacctcattttattgcacttcactttactacactttgcaaattacagtgttttttttttaattgaaggtttatggcaaccctgtgttgagcgtctgtcagcatcatgtttccagcagcgtgcactcactttctatctctgtgtcatattttgataattctttcaatatttc

SEQ ID NO: 81280 - DNA, 631 bp, Homo sapiens
gtaaaaataacgtgactgtcttcttatcttggaattcttttttagtttttagcagagttacatttcttcgttgtggtaaaatacttaatgccactgaactgtcacttaaaatggttaaaattgtgcactttagattatgtatactttaccacaataaaaatgaatttttttttttttgagacggagtctcgctctttcgcccaggctggagtgcagtggtgtgatctcagctcactgcaagctccgcctcccgggttcacaccattctcctgcctcagcctccggagtagctgggactataggcacccaccaccgcgcctggctaatttttttgtatttttagtagagacggggtttcaccatgttagccaggatggtctcaatctcctgacctcgtgatccgcccaccttggcctcccaaagtgctgggattacaggtgtgagccaccatgcctggccataaatactttttttataaagccagtgagctgatggggaacccggcaaggtgtgacatctgtaggactcaaaggttgtagtgaagttttctcctagcacgttaatgttctgtgttgatgacacatgtaatcagaacgccttcgccatatatgaagacctttaggaaaaagcc

SEQ ID NO: 81281 - DNA, 1021 bp, Homo sapiens
gggtcatgagtttcaaccagaaattttcttttttaatgagatagaattcaataatattttaagacgacatctcagacaagaagagagactgttattccatgcaccttttgttttggatctatcacattatgtaagtatgtgtgtacaggatcccatgtgaaaaatatttatttcttgctatcttgcctctgagtagagaaagataacagacataaagaacacagaccagaaaggaaagattgggattttgctttgaaagctattgcttaaagttatttccacaaatgtacaagaatatgtaagaatgtatatttatcattgtaatagtgaaaaattggaaatgtcaatatcctctgtaaaaggaatgcagacaacagaatactatataacactgaaaatgaatgaactagagctatgtgtattgatattgaccagttgataaatctgaaccacatgaagttgagtaaaaaaagcaatttgcagaaggatacatacaaaatgacaccatttatatagtagactgaaagcatgcagaacaatccattgttgtttacgtgtgtaacagtcataggaatgacaaccactgccttcagaattatggcgacctctgcgatggaagagaatgggatcagagaaggatacacaataggctttaactgattttgtgattattgatattagaaatgtttaaaattaagatattaacatttcatgaagctgagtggtgagcacaccagtgttatattctctctatataactttgtgtatatttgaaatgttttctcataaaaagtatttaagcaagtttaggaaagaatattgataaatgaaatctagagaccatcaaaagccaatttcaccatcacaaagtataattgtgtttcaaatataattgaaattgtgtgactgttgcatattctcttttttgttgttgttaatgaaagcatcttaaacagttgcctttcaaagctgttatctttgataataacatacattaacctaacattgtggacttctgtta

SEQ ID NO: 81282 - DNA, 104 bp, Homo sapiens
cagctcctcttcctcctcatccgggtctcagctcaaatgtcacctcctcgggaaggcctccctgatccctccagctagtaatgtcacctgcacacccagtcact

SEQ ID NO: 81283 - DNA, 1319 bp, Homo sapiens
  misc_feature (494)..(494): n is a, c, g, or t
aaaacctgtgggtgcctcagaccacagcagagctcacagaacctgcgggagccaggctgacccgccagcatggtagagttcgcgcccttgtttatgccgtgggagcgcaggctgcagacacttgctgtcctacagtttgtcttctccttcttggcactggccgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggcttctcttcgatcttccccggtatccgcccccatctgatgatgcngaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacggggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtaacagctttggtttaataccctaccgccggcccatcaccactgtgggtaagtccaggaccaggctgggagggaggaggccaaagggacagggcaggttgtgtgctgcaaggggacatggagatgagccagatttattcctgccctaatggggctcacattctagactgggaaacatacacatacaagcagatagaatagaagacagtctgggataggaactatagcagaggtgccaacagcaatagttgtgactaattgctgagcacctgctgtgtgccaggcactacactagctgccctacatgaagcaactcagcttatcctaacaatcttcatggcaggatttttttttaagagttttgctcttgtcgctcagcctggagtgcagtgagctgagattgcgccactgcactccagcctgggctacagagcgagactctacctc

SEQ ID NO: 81284 - DNA, 1964 bp, Homo sapiens
  misc_feature (494)..(494): n is a, c, g, or t
aaaacctgtgggtgcctcagaccacagcagagctcacagaacctgcgggagccaggctgacccgccagcatggtagagttcgcgcccttgtttatgccgtgggagcgcaggctgcagacacttgctgtcctacagtttgtcttctccttcttggcactggccgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggcttctcttcgatcttccccggtatccgcccccatctgatgatgcngaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacgggtatcaagcctctgggaagagcactctgggttcagttggcaattggcaaggattttattttggtgggaagatggcagagacgaatgcagattctattttggtagagattttcagtccattcacaattaagattatattttggtgtcttatgcccaaatacctagaaaagtttccacaacggagactcagtgatctaagaaactaggtggcaatgaacatattccacaaagctggcatttgatctgagatctgtggtatctagaagagtgatatttggggtacatttcagagctgttctccctccttggggtgaggcatccttgagaaacatgagccagctgaggtgggagatatttttctaggaaaaacaatgcagatttttatatctgggaggactctctgaagcattctggtctacctctcatggtgcaactgggaagttgtggccctgcaagggacctgcccaaggtcagagaatggggctgtgaaggtctgggagataacccaggcctccacctccagcccaggtggctgacctctgctccatttcttggtcactgagtccctgcaggaagctaaagggcctttcagctcgtgccttctctggggcctcccacatgccctctttcctctatttgtctccagggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtaacagctttggtttaataccctaccgccggcccatcaccactgtgggtaagtccaggaccaggctgggagggaggaggccaaagggacagggcaggttgtgtgctgcaaggggacatggagatgagccagatttattcctgccctaatggggctcacattctagactgggaaacatacacatacaagcagatagaatagaagacagtctgggataggaactatagcagaggtgccaacagcaatagttgtgactaattgctgagcacctgctgtgtgccaggcactacactagctgccctacatgaagcaactcagcttatcctaacaatcttcatggcaggatttttttttaagagttttgctcttgtcgctcagcctggagtgcagtgagctgagattgcgccactgcactccagcctgggctacagagcgagactctacctc

SEQ ID NO: 81285 - DNA, 724 bp, Homo sapiens
gtttttttttttatgttttgggtttacactgtttttgtgagttgtaacgcttatcacgaaagtctgcagtttcagtcttgaggttagcgagactacaaaaccaccaggaagaacgaacgattccagacgcgctaccttgagaactgtaacactcacggagaaagtctgtagcttcgtttctgaacgagcgagaccaccgaatccaccggacggaaaaaactctcaacacatccgaatatgggaaggagcaaactccagaaacgcgcctttaagaactaagtaacactcaactgcgagggtctgcggcttcatttttgaagtcagaccgagaacctacggattccggacacaagtccagctcgtgaggtggggaaggggaagggggaggggagggaggaggttcatatagtaagagtaacctgggagtgtggggaggggatagaaccctgctcactgccccctgcccatagtgaacaatcggcactatctattttgccctccagacactaccgtttccgtagagacagtactaagaggaggcttatttcctcctgtagacctagcgggagggcggaggcttaaatctagaaaaccaaccattgagagcaggtgaattctaggtatgatgagctcattttctgacctgcagggggtgagggtggttaggggtaaacctgtgatcccaaaggcaccaaggggagcgtcagcaggtctctgggatatg

SEQ ID NO: 81286 - DNA, 464 bp, Homo sapiens
agcaactatggagaggccccttgagaaaccaagttgttctctaggaattaaaacatcaaatgcatctttacaggattcaacttctcagccaccaagcatcaccagtttaagtgtgaataatcttatccatcagagcagcatcagccatcctctggccagctgtgcgggtttatccccaacttcagagcaaacaactgtgcctgcaacggttaatctgaccgtttcatctagctcctatggcagtcaacctcctggaccatctctgatgactgaatattcccaagaacagctaaatactatgactagtaccataccaaattcacagattcaagagccactcttaaagccaagccatgaaagccgtaaggattctgctaagcgtgctgtccaagatgaccttttactgtcttcagctaaacgtcaaaagcactgtcagccagcccccctcaggcttgaaagtatgt

SEQ ID NO: 81287 - DNA, 1095 bp, Homo sapiens
gtacctttctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccaggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggaaccttccctctcatcccaaggagccagagtcctcccaagatcccctggaggaggagggatccctgctgcctgcactgggggtgccaattcagaccgacaagatggagcattgatgggggagatcagagggtctgaggtgactcttgcaggagcctgtcccctcatcacaggctaaagaagagcagtagacagccctggacactctgaagcagaggcaagacaaacacaggcgctttgcaggctgctctgagggtctcagcccatcccccaggaggactgggatttggtatgatcaaatcctcaagccagctgggggcccaggctgaagacctggggacaggtcgattgctggaccagggcaaagaagaagccctgccatctgtgccctgtgggccttttccctggggcagcaccttgccctccccaggggatcactcacttgtcttctatgaagacggactcttcatgaggttgaatttcatgccagtttgtatttttataagtatctagaccaaaccttcaataaaccactcatctttttgttgccctccccaa

SEQ ID NO: 81288 - DNA, 555 bp, Homo sapiens
gagaggactggatggggcctgatacatgggtgtggccccaaagtaaggaaacgctttccagggacctggagagaagaaaacctgggagggtctgaaacagtctgaggcatacaaaggggtgactccctgtgctaactttttcccactttcccactacccagcggtgcccactccagagagttctggccagtgcttgaggctccaggtgtctgtctgctgcaaggagaggaagtaagtgggttgggagcatggaccctactggctaatgtggggccttgggaaggagggaaggagtgagaagaatctaggaggatcagactccaggggtcctggtgaagcttcaagctgtggtctcttctccccatttagccttgagggagcttctactgcaccatcctctccccacttctgttttgttttgttttggttttagacggagtctcgctctgttgcccaggctggagtgcagtggctcgatctcagctcactgcaagctccgcctctctggttcacgccattctcctgaatggaggccaaggggatccttagatcacc

SEQ ID NO: 81289 - DNA, 1307 bp, Homo sapiens
gtacctttctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccaggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggaagtctgagtcagcccatcctgttgggagccctggagagagtggcacatcagggtggcgagggggggacactcccagccccctctgtctcttgctattactgctgcttctgattcttcgtcttctgcgaattctgtgagccaagcagaccttccctctcatcccaaggagccagagtcctcccaagatcccctggaggaggagggatccctgctgcctgcactgggggtgccaattcagaccgacaagatggagcattgatgggggagatcagagggtctgaggtgactcttgcaggagcctgtcccctcatcacaggctaaagaagagcagtagacagccctggacactctgaagcagaggcaagacaaacacaggcgctttgcaggctgctctgagggtctcagcccatcccccaggaggactgggatttggtatgatcaaatcctcaagccagctgggggcccaggctgaagacctggggacaggtcgattgctggaccagggcaaagaagaagccctgccatctgtgccctgtgggccttttccctggggcagcaccttgccctccccaggggatcactcacttgtcttctatgaagacggactcttcatgaggttgaatttcatgccagtttgtatttttataagtatctagaccaaaccttcaataaaccactcatctttttgttgccctccccaaaaaaaaaagggggggctagattcccggggccattccgtccccgtttgccagggcccagggggaagc

SEQ ID NO: 81290 - DNA, 1241 bp, Homo sapiens
gtacctttctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccaggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggaagtctgagtcagcccatcctgttgggagccctggagagagtggcacatcagggtggcgagggggggacactcccagccccctctgtctcttgctattactgctgcttctgattcttcgtcttctgcgaattctgtgagccaagcagaccttccctctcatcccaaggagccagagtcctcccaagatcccctggaggaggagggatccctgctgcctgcactgggggtgccaattcagaccgacaagatggagcattgatgggggagatcagagggtctgaggtgactcttgcaggagcctgtcccctcatcacaggctaaagaagagcagtagacagccctggacactctgaagcagaggcaagacaaacacaggcgctttgcaggctgctctgagggtctcagcccatcccccaggaggactgggatttggtatgatcaaatcctcaagccagctgggggcccaggctgaagacctggggacaggtcgattgctggaccagggcaaagaagaagccctgccatctgtgccctgtgggccttttccctggggcagcaccttgccctccccaggggatcactcacttgtcttctatgaagacggactcttcatgaggttgaatttcatgccagtttgtatttttataagtatctagaccaaaccttcaataaaccactcatctttttgttgccctccccaa

SEQ ID NO: 81291 - DNA, 959 bp, Homo sapiens
gtacctttctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccaggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggagtgactcttgcaggagcctgtcccctcatcacaggctaaagaagagcagtagacagccctggacactctgaagcagaggcaagacaaacacaggcgctttgcaggctgctctgagggtctcagcccatcccccaggaggactgggatttggtatgatcaaatcctcaagccagctgggggcccaggctgaagacctggggacaggtcgattgctggaccagggcaaagaagaagccctgccatctgtgccctgtgggccttttccctggggcagcaccttgccctccccaggggatcactcacttgtcttctatgaagacggactcttcatgaggttgaatttcatgccagtttgtatttttataagtatctagaccaaaccttcaataaaccactcatctttttgttgccctccccaa

SEQ ID NO: 81292 - DNA, 539 bp, Homo sapiens
attctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaagaagatgattaaaatgaaattttgtgagaatagttttgttca

SEQ ID NO: 81293 - DNA, 383 bp, Homo sapiens
taccgtgaaccaaaacacagtgcagaaatcaactgggtgctaaccttgcattgactgcacaacctcttaccaaactcctggttttgtgctcaccacagaaccacatctccctggtctaacaatcaactttaacaggaaatatgataaattaaaatgtataaaatacctttttacagactggaagacaacgtctggttttgcttaggaaaatatcaaatgcaaaccctcaatttacagaggaagaccctgaggccagaaaatattatgttttccagttagaatcaaaccagcaccccaattcctgcctaatactacatggcctccgccaaaccaagctgagtctaccagctgcatgcggaaactcagaaaggaagagacctctc

SEQ ID NO: 81294 - DNA, 794 bp, Homo sapiens
tgtatgctctgttcaatcgttttgctgaatatttattagcattccatcactttgtgtttaattaatagaagttgagttcaaacaatgtttttaaaattcacacaaagctcgttagattcttttaactctgcctggcaacgcatttgtgtcttctggcatagttttggataacactcatgaactcaactccatctctttcattagaaaagagtattgctaagtgcatgtacatgtcatattaagacatgatacacattgcctagaaatgctaaaacagtcttaattcttcggcttgatttgcttgtgtgtgtcactctagggaaattttctaacagtatctttttgatggtgtgttccagaaatctttttaaatagttacttttagaacaggaagttttaaaatttgtagtaccatgtttataaaataaatttttaaatagttctgtagccatttaaattaatacataaatgtaaattgtgagatgagataaacatgaaggtttaatctttcaaatagttttccaaatgtagccagaatgtgagtactttggggtatgctttatagtttctcttagaaaaaggaaaaatagcactctgtttagaaatgtaataagagtagctttcaaaagtatgatgatttatttcaaatagctaactttgagctgtcatgatgttgatgtgaatgatatatattatttttatcagtgtaggaaggtttgagctatatttttgataatttgaatatgatattgaaaggtttattttgtttcataataaaaccaccatagaagttg

SEQ ID NO: 81295 - DNA, 333 bp, Homo sapiens
aaaaagtaaaaaaaaaaacctttaggtaataatgagatctctgaagaaaaatattgtgagggaatggaaaggaagggagttgggtttgggatggcgagtaattgagagttagtatggtcagcaaagttctctgagtaggtatatgaatgatgtgatgtaacacaccacacgcagttctatgcaaagcatttcccagatggagggaatattaaatataaagtctctaaggcagaaaatgcttaggtcttagaagataaacaagagtccagtgtatggctggagaaaaataattaagagggagagtgtcaggggaggagatcagagacatggaca

SEQ ID NO: 81296 - DNA, 700 bp, Homo sapiens
tcccacacttctgaggttttctttccaggacagcctggtttcccttcttcggcttattgttccatcagatttcagattttgagttctgatttttggtcagaagagtaaagtttctgggattggggacgtgtgtgctatgggaactcagtgtgtccccagcccttgtttgtaaacaaggaagggacagagatcagggaaataaaggcagaaggcagtgagagggaggctatgcctgctgcttggattctctgggctcactcccacagtgagctgcacactgtgatggagactcctctggagaaggccctgaccactatggtgaccacgtttcacaaatattcggggagagagggtagcaaactgaccctgagtaggaaggaactcaaggagctgatcaagaaagagctgtgtcttggggagatgaaggagagcagcatcgatggcttgatgaagagcctggacaagaacagcgaccaggagatcgacttcaaggagtactcggtgttcctgaccatgctgtgcatggcctacaacgacttctttctagaggacaacaagtgaccagggctgccctccaccctcaccctccaccctttgctgctgacctcggctgctcctctcacagaccctctttggccccctgccctcctctccctcccagatggacccttccatgggaggaaataaagtttccatcgca

SEQ ID NO: 81297 - DNA, 485 bp, Homo sapiens
ttttttttaattattattttgtatgtatataaaagaacacaaggggacccctaagctgcacactgtgatggagactcctctggagaaggccctgaccactatggtgaccacgtttcacaaatattcggggagagagggtagcaaactgaccctgagtaggaaggaactcaaggagctgatcaagaaagagctgtgtcttggggagatgaaggagagcagcatcgatggcttgatgaagagcctggacaagaacagcgaccaggagatcgacttcaaggagtactcggtgttcctgaccatgctgtgcatggcctacaacgacttctttctagaggacaacaagtgaccagggctgccctccaccctcaccctccaccctttgctgctgacctcggctgctcctctcacagaccctctttggccccctgccctcctctccctcccagatggacccttccatgggaggaaataaagtttccatcgca

SEQ ID NO: 81298 - DNA, 445 bp, Homo sapiens
tgtggaaaaccagttcctaagctggaagaagcagagagaaaatcgtgacccttgatctgctccaccatctgccaccagggccttttgaggaggtcgtcttctcatctttctgcctcaggcctacttttcaacaactccccagcaggagagtctgtggtctcctttggggtcttgctgttctccttgtaccagcagctccagagtttgttgtgggtctcattgtaacctgtactgatatagatgggcgctcttgttagtggatttcagtctcatcctgggttccagtctcttgttctttgagggaggggcctcagaggtaggctagtgctgctggtggtgacttcctgaggaatgggatcttcccctctccctctacaagctgcacactgtgatggagactcctctggagaaggccctgaccactatggtgaccacgtttcacaaa

SEQ ID NO: 81299 - DNA, 506 bp, Homo sapiens
cagccccctctcagccctggactctctctttgccctgtccccgactttaataatgggacactcctcgatatcagagctgcacactgtgatggagactcctctggagaaggccctgaccactatggtgaccacgtttcacaaatattcggggagagagggtagcaaactgaccctgagtaggaaggaactcaaggagctgatcaagaaagagctgtgtcttggggagatgaaggagagcagcatcgatggcttgatgaagagcctggacaagaacagcgaccaggagatcgacttcaaggagtactcggtgttcctgaccatgctgtgcatggcctacaacgacttctttctagaggacaacaagtgaccagggctgccctccaccctcaccctccaccctttgctgctgacctcggctgctcctctcacagaccctctttggccccctgccctcctctccctcccagatggacccttccatgggaggaaataaagtttccatcgca

SEQ ID NO: 81300 - DNA, 552 bp, Homo sapiens
cctaattccagagcatctggctgggttgttgggttctagactttgtcctcacctcccagtgaccctgactagccacaggccatgagataccagggggccgttccttggatggagcctgtggttgatgcaaggcttccttgtccccaagcaagtcttcagaaggttagaacccagtgttgactgagtctgtgcttgaaaccaggccagagccatggattaggaagggcaaagagaaggcaccagaatgagtaaagcaggcaggtggtgaagccaacccataaacttctcaggagtgacatgtgcttccttcaaaggcatttttgttaaccatatccttctgagttctatgtttccttcacagctgttctatccattttgtggactgtcccccacccccaccccatcattgtttttaaaaaattaaggcctggcgcagcagctcatgcctataatcccagcactttgggaggctgaggcgggcggatcacttgaggccaggagtttgagaccagcccaggcaacatagcaaaaccccattctgctttaaaaaaa

SEQ ID NO: 81301 - DNA, 566 bp, Homo sapiens
actgctgccttactatacctgatttaaacaaatcctgagcacattttaaaacataaattcaacagctggacctgctatgcagagcaattcaggcggagggaatggctcatgcacactctccaagtactgttaggtatgagttctaaatttctcttcaaagaatcaatatgtcagtatgttcagttctttgccttctactgttaaacttaacttcctcgtaaagcaacctttttccattacctgctccaccctgactcattctgattacctgctcattctccaccctggcttactctgatttcctgctctgccctgtaaccatttttcccgccaaaccactcaccctgtcactctctttaaattagccaattggaattagtttagcctgtgcagtctaacccaagccaataggggaaccatacagcagcagggaccacgtgcctcagggataagaaccccttcccctcccttgtccaagtgtgcgctcacgattgctccatctgtaagggtgcacccttctatagaagtacgttgtcttgctgagaattaaaaagaaaattttatat

SEQ ID NO: 81302 - DNA, 711 bp, Homo sapiens
ggctgttgagactccaggggtgttcggggctgggagcctgctgagtgttccctgttcccacctccaatctgctccatcctccagctgcatttcattccggatctaccaggatccaactttactactgtcatggagggaattacagtaattctaccaacttttgaggcaaccttcttctgacactgtgtgaaacagactgaaaagactctaaagatggagagagctcaatgcttgagaaaaggaattctgtcctttgaaaggtctctagaacaaaggagtcttattctgtcacctaggctggagtacagtggtgcaatcacagctcactgcagcctcgatctcctggactcaactaatcctcctgcctcagccttctgggtagttgagactacagatacagaagatgagagagagaaaaagagagaaattacagagtgacggagaaggcagacatcatgcaacatgctcaagggctattcattttaagctgaaacatacatgtgtagaaagcatccttgtacttataatcccaatgactatgaagaaaaataatttagccaaatagttcctagaacaggaaaaataaggaattatattttgagataagaagttaagctctagtataacaatgatatgggtcaaagaaaaatgaaaacaaattttaaaaacgttgcaacatgaataaaagtttcaccaaatcgggagtctatt

SEQ ID NO: 81303 - DNA, 794 bp, Homo sapiens
cgtgtgcagagtaatggcaatatagccaccccagtgtgggggagcagtcggaggagggtaggttaaagagaaaaactgatgctgggtgtaatcactcatacctgtagtcttagctacttaggaggctgaggcaggaggatcacttgagcccaggagtttgaggctgcagttgagatgggtaagtttcctggacccctcgtgggacttgtaatggggtgtgacttgttttgcttggccaccgagctcaaacttcttgtaggagggggagcacacagtttagcacctgcaggagcctgggcgagtggttgccagtgacctctggagccccaggtgtatgttacaaataatgctcttttagcagttgtcatccacggatggctaagtgttaaccagctcagtggagagtcggggtgacagcctttttcaccctcccgtcttggtacctgggttcctgtctggtgtccaggaagaatcaggtcacatggacttgaaggatggtgaatgtgtaggttttattgggtgatggaggtggctctcagcgggatggggagctggaaaggggaaggaataggaagataatcttcccctggagtttgactattcctaaggtaatgcccacggtttccagtgttgaaggtggggcctttgcagggaaccaccctcttctacccagtatttccctgccgcctgtccatatcattcctagtgagctacgatagtaccactgcaccccagtccaggtgacagaggcacctggactctatttttttaatagaaacctgtctctacttaaa

SEQ ID NO: 81304 - DNA, 362 bp, Homo sapiens
tggtaagtattcaaaaatatcactcatatccagaaagatcctgcttagtgttaagctgcttccattttggagaaaactggttttaaaaattacaaatccaaaatttgatccataaaccttttacaatacttaggtttttttttaaaaaaaaaaaacacttgaattaaaactataggaagcaaaacgcttacagaggtatcactatttactttcaggtttttaaaaagaactctggtgaacaattcattcatttattttatttttaaacctgagaataatgtactccaaagaatgggtggatgaaaggactaaatcattagcagagtcttcttcatctttggttatgtataatgcaaatattc

SEQ ID NO: 81305 - DNA, 357 bp, Homo sapiens
tttaccagtttactcaattaacaggtcagcatataaaacctggatcttctgacccttgattgtaccacactctgaaatgtatataaaatttatgattaccacaaataaagatacttcaaagaccctaaggaaggaaacacagaagaagggaacagcttcctcacctataaaataataaaaatgtggtctttttgacatccttgagctaaataaggtcgcaaggtggagcccactgcccagaagttttacccaaatagtctaacatagaaataggcctggaaacaggaggagtaacataaatttaaggcttaccagtgtataaagtaccttctattatcatttgatcctcactactca

SEQ ID NO: 81306 - DNA, 449 bp, Homo sapiens
tataaggaattctaagctcaaccacatttacaaatgctcagccctcggggttccaagactgctggtcttgggataccttagtgcggcatttatgacacaacacagctttgaggcatttgtccttggctggaaatgtcacacctgggagcaggcacaccctgcaagaggctattccgctgccacccaagcaatgaattatgagacaaagcaaaaattacactgatgttacagagacatcactgatccctgcaatgagtaataatcttcttttgactttgaactggtaggcaaatggaagaaatcttaacagctgacaacatcctagctggtaattaaaaaaataatctttagtactccagtttgaaatttggtctttcacggaaattttccctcatttgggaggtcaccaaaattgtgctagctttttaaatttttattattttttttta

SEQ ID NO: 81307 - DNA, 470 bp, Homo sapiens
ctattgttgaaatttctgcctggctgtagaaagcctctggggcaatagcagatccttccagtgtggggacacagttgtgccatctgaagagggtggcatgttgggtggattgggcagccccaggccaaagaaggtggcagttctgcagtcggaccttttacttcactgtctacacatctgtattatttcgctggggctgccatagcaaaatactacatacagggttggcttaaacaatagaaatttattttctcacagctctggaggctggaagtccaaggctaaggtgccggcagggttggtttcttttgaggcctctccacttggcttgcagatggctgcctttcctgtgtgtcctcacacagtcttgcctctgtgctcacatccctggtgtttctttacgtgcccagctttcctctttccatgaagacaccagccacattggaccaaggcccacccaaacagcacca

SEQ ID NO: 81308 - DNA, 483 bp, Homo sapiens
aagcagcactgtgaagaggcgcaggtggtaaaactgaagaccttcacaaacagccagcactaatttgccaaccaaatgacggtctttggaaaacagatcctctggcctcaggtgaaaaatgagaagattaaataagccatgggaagattttttaaaatgacatgaaactccaagggtaaaaagtaaccttctcccgcagtatcctggttcccatgctttctgtacccacgtgcctactcttgcaatctatacattgttcctgttcagcagagtttggatgaatacccaacagcctgaggagactgactgttacttgaaatgaaggagtgttcttgtttgaacgatcctgctcagaaggaccagcctgggcttgcatctcttgtagtattttactaaaccctgcaacagtagccactttttttccctgccaagttatctaaatgtagagcttcctgtggtctgagttttaagagattacaggtg

SEQ ID NO: 81309 - DNA, 373 bp, Homo sapiens
aaacaccaaccacccagtgcatgctaagctcacactggcctcacaaagtagacatgatggggcaatactttccaaatcaaattgaagtatttgacattagccccacatcattcacacacacttatactaataaggatttttagccacagaaaatgaatttttagtctaactagtttaagcacaaaggatttattgagtgtgaagacagcttaaagaattttggggaagagtgaaacaacttccaggtatgatttcaaaagtccctagactgcccagggagctgattcccctgcttgattaggaagttgcagctgccaactccagaaccttattacctcttataatttaccatgaagaagttaccaaatcagag

SEQ ID NO: 81310 - DNA, 462 bp, Homo sapiens
ccgtgttagcgagggtggtgatggtctcgatctcctgatctcatgatctgtctgcctcagcctcaaaagtgctgggattacaggcgtgagcccaccgcgcctggccacttccctgtttttaaaccatctctttctgctctagctctccctgttccttcctgttccctacacatactctgttctggtctctctcagtggtagtggtggtggtatgggctctggtgttagactcactgagtttctaatccaacatccaccaacaaccttggcaagttacttcacctttttgaggatcagcatcctcctgtgaaataaccccacatggtggttgagaggagtaaataaaaaatcatctgtacctcataaatatatatacctactatgtacccccaaatgtaaaaattaaaaaaaaagtaaaacgacatctgcaaacccgctctcattcctgagaccctcttcaaa

SEQ ID NO: 81311 - DNA, 816 bp, Homo sapiens
ctggccacagagcagttaaccttcttatctatgtggaatattttccatttgtctcaggctcacttgtttattctgcaacatttctggaatactaactttgtatgggctcctgccctcaggcatcttataggctgttggaaggaaaaggaccaaaataaggaacaatagtaaaaaatagtcatgaagcctgtcatacctgttccctttcttgttcctcatagcctcatgggtaggcctgcaggggttgtttttggccatggtgaggacatttgagaggacagtccttgtcttgcaggctggctgtgatgattccaggaaatggtacacagaggacactgctggccaaatgttccataggaacacatgtgcatgcacaccgcagtcttctttctagtttaccgagctgctcccagcagttgtcattatatatgcagttctacatgtcagtacatttatctaaaatccattcacagtccacacataagattttaagtacttgtgataaatgttgtctttgttccactcccggtccctccccttttctcctcccctcctttggcccagagggctgcacagtgcctctctcggaaaaagtacttcataggtttgccatgaggactgctgggaccaaggccacttgctcgccagggtgtttcatattccagtcagatgatctgggtgatacgggtttggtttggagcccaccttccaagaatgaaagaggccacttaccactttgtctgacactttgcagtccgccttcactggctgaaagactgactcttaggacttctaccccaaaccatagcacctagg

SEQ ID NO: 81312 - DNA, 378 bp, Homo sapiens
tcctctccctccataagtttgaagaagagggtgtttctcctgtctctgagggaattacaacctacatcctttcctgccatttgcctacaaaccttgttgtaccaattaatttctcttttctttcttaaaaaattttctttttaatgtaaaagttttactatggcttgatcaattgaatgatagggagaaagttttaaatagcaaacagatgtgattttgacagctaaatattagaattaacataacttgcatgggcacagtggctcacacctgtaatcccagcactttgggaggccgaggcaggcagatgacttgagattaggaattcaagaccagcctggccaacatggcgaaaccccatctctactaaaaatacaa

SEQ ID NO: 81313 - DNA, 136 bp, Homo sapiens
tctgtactccaggctgggtgacagactgacaccctgtctcaaaaaaagaaggtttgtacatactgtaacaggatatgaagctccagatagagcaaaattatggtgacagaagtgaatcagagattgcgtgagttgg

SEQ ID NO: 81314 - DNA, 278 bp, Homo sapiens
atgtttgaggtgatatgctaattaccctgactcaatccttgtatgcatttatcgaaataccacatgtaccccataaatatgtataataattatgtattaataaaattaaacattttaaaaaatgtatatagagagaaggaagtttctctctccctgtcctcctttggctttgccagctcaccttcctaaaagcagtcacctagtttattgtatgtccttctggaaggatctctgatggagcttagctaatgacaatccacagcagccacagcccaggc

SEQ ID NO: 81315 - DNA, 278 bp, Homo sapiens
gttgggtctcgaattcctggggctcaatgtaattctcccaccagggtcccccaaaacactgggaatcacagtgtgagagccaccacacccagccctccttttctttctttctgttttttttttggtttgggtggtggtggtggttggtttttttggagacggagtgtcgctctgtcgcccaggctggagtgcagtggcgtgatctcggctcactgcaacctccgcctcccgggttcaagtgattctcctgcctcagcctcccaagtagctgggactac

SEQ ID NO: 81316 - DNA, 91 bp, Homo sapiens
gctgacaccacccctaaggccagcagccaagagtctcagcggtgtcttcaactcagccaacccaggagctgctcagccaccaggaaagaaa

SEQ ID NO: 81317 - DNA, 507 bp, Homo sapiens
cgatgcgatcaactggaagaaagggtatcagtgatggaagatgaaatgaattttaaaacattttaatgagaatttcttaattttattctctgtgataggatggactggtgcaatttttttttttttttttaacaaacgagggaaattaagctagaaagcataggtggggacctaggattaaatgccatatattctaattccaagtccaagtccaatcctcttttcattatgccaccctgattttcaacatcagtatggtatcattgacttaaaatctagggaaaataagttataactaaaatatctttacattatgtctaacatatgacctgtatgagcaaaaatcagttttgagaaagcatcaatgaagctgagatctccccaagtcattacttacccacaaagaaaagcattgtttcccaatgaataaataattgcaggaaatagtttgcagtaatcaatttgtatgagtaaaaataaagatattttatattgagtatttcctca

SEQ ID NO: 81318 - DNA, 200 bp, Homo sapiens
cagtagcagcacatggtgcgatgtgatctgtgattatatcatcgctagcgctgtactgtcactacattcctgagctttctatggctactcgtcttctgcagagcagctatgatgggagctgccattcaagccttacatgcgtttctgcatttaatccttactcctgtgaggtaagcagtattttaaccccattttacaga

SEQ ID NO: 81319 - DNA, 338 bp, Homo sapiens
aggaaagcaggggtctcaattctgtacgaaagaggagggtgttttacttcctggaattatagaggccagaggtgtctctttttcaatttattgggaaggtttattttaatatggacttagaaataaataacttattaaagtgaaggttcacctggagccttaggctggctgctaagtgtgagtctgggctgttgaagggactgtgctgttcttctgggtctctgtaggagtttgaaggagaagactggccccaaagggtgtttgaacaggttagatgtgcccattggttagaacttacttggatagggagaagggatctagggcgtatccacaaactt

SEQ ID NO: 81320 - DNA, 381 bp, Homo sapiens
ggcaacagagcgagactctgtctcaaaaaaaagaaagaacacttgtaatactttctatttgaagagcataaccacataagatttcagttgaaatttcatattttcatattttctatctatcttttgcatatttggacagtttctctaagttgaaattagggactgtattctactttcctcactgaacatttaatcaattttctttcatttcctatagttgttataattgtctgtaactggacctctaggttagtttgcctgttgcttccttaatattaattatcaggttgaactaatgaacatttagttacttagttccctataaagccaacattgcattatagttctaaagttggacacttgtttttaccttttttgctg

SEQ ID NO: 81321 - DNA, 453 bp, Homo sapiens
aatctgtatacagttttagctccatttgatattagtcccctttaagtaagtttaaagtgattatgattaggaaatctatgaggctttaaaaaatttttcttttaattttggtgaaatacacataacatgaaatttaccatcctcaccatttttatagtatacagttcagcaatgctatgtacagtcacattattgtgcaaccggtttccagagctctcagcttacatgactgaaactctgtatgtattaaacatctccccagcacccctttttctagcctctggcagtcattattctgctttccatatctataaatttgactactctacatacctcaaataagtggaagcatacagtatttgtccttttgtgactggctcgtttcacccagcgtatggtcttcaaggttcatccattttgtagcatgtatcacaatttctttcctttttaagg

SEQ ID NO: 81322 - DNA, 437 bp, Homo sapiens
taaatgtactttctgttttaagttcagtttcctgttacttgcagtcaaagacttccttggtgatatacatttatcaataagtgtctttatttgattgattttagtgtcaaagaacctcttagaaagaagaggatgctttttaaaaagtgaaaaaaaaaaatcactagttcactttgattgggaaaggaatttcatcctagatagaaattttttaaaaatatgtggtttttattcctgttcattccttgttcataaacttgcacattaaatgttattttaaactttagtattgttcacgatttgaagataaaaaagtggtgggcacaatggctcactcctgtaatcccagcactttggaaggccgaggtgggcagatcacttgagcccagggatttgcaaccattcaggttttgaacatagtaagaccctatctctgt

SEQ ID NO: 81323 - DNA, 415 bp, Homo sapiens
caagagagagggtggggaggtgctacacacttttaaacaaccagatgttgtgagaactcacaagggggcatggtactaagcaattcatgagaaaccatccccataatctaatcacctcctaccaggccccacttctaacactggggattcgacatgagatttagtggggacacagacccaaatcatatcattccacccatggccccactaaatctcatgtccctctcacattgcaaaatacaattatgtgttcccaatagtccctcagagtcttaacttattccagcattaactcagaagtccaaagactcatctgagacaaggctagtcccttctcccacctcagcctcccgagtagctgggaccacaggcgtgtgccaccatgcccagctaatttttgtatttttagtagaga

SEQ ID NO: 81324 - DNA, 2299 bp, Homo sapiens
caagtttgaactgtgcaggtccacttatatgtggatctaaaatacagtatttgtgggatgcaaaatctgagtatatggaggaccaactttttgtagaggcaggttcctcagggttaactgcaggacttgagtaagtgcagattatggtatgcacaggggatcctggaaccagtccccagaccaaaaatgaccactgtatcttgagagcaccttcatggtcttctttcctgtccccagtcgtaagatacgacccttcatctgctttgtctcaacattctgttagtggtgaactgataactccagcttttctctctcttttttttttttttttttttttgggtggtggtggtggtgggggtttgaaggcaaatcttggctcgggcccccaggtgggatttgcagggcgcacagaatctcggggcttcactggcaagctcttcctgcctctgcctcccgggttcacgccattctcctgcctcagcctcccaagtagctgggactacaggtgcccgccaccacgcccggctaattttttttgtatttttagtagagacggggtttcaccatgttgggctcgatctcctgacctcatgatccgcccgcctcggcctcccaaagtgctgggattacaggcgtgatgagccacctagtgctaattcatctctaaacctctgtagttggagtctcctgaaatctcagactacctcctgctttcattttctacccagggaatacactattgtcctaagttatttagccttgaaatgtcagaggcattttaggttcttcatgtttctcccactttcagttgattaccattacaggatcttaggcttctttttatctttttgcagtgccttgcatccactggttgttgttttactctgttgggcactacttatttccttacctctggtttcttctcctacagcttatgttctgaaatgtgtattcctaaaatactgttttcctcttgttacttttctgctcgaggacttccagtaacttaccattgtttataaggtgatgttcaaacccttcagtctggagactttctgccacctatctgactgtacctttatcttcaagcttatctctttccaaacaagaggctcatttagcagctttctctgattgccatgttcatcctacactcagcctcattcagtttacagcatggaaactgtataggacctctttcctatagaaattgaagacacttaaataggaagaaaattaaaatatacatttggatacatgagtattccagtcaaataatatctataaaataccagatagagtataaaagacaactgaaggacaacagagtgatgaaaggactttattaggcatttggattggttatgatttaaatttcaatttaattagaacgtttccatggcaaggaaggaagcatggaggactgtggaaaagtcattcagtattgagttcatttgcattagaggaatttcatagtttaaaacttgtatatctttacctatccttcgtatgttttcttcttaagcatatttgactttttctacctcagcatctgtataagaaaatatttgtgagtcagatgttgtgggttttccttacctattattattttcttccatgctttacaacacattttttaaactaccttgttcttaaataattacacggacctgcttctgtgtactttcacagaatctttgacagttaaaaattgtatgttatataaaaatttgacaagcttctacagttaggaaaagcctttagaaatctgccttccccaaaccgtatgttatcatagcactcatgtctccccatgtctaaaaggtaaatagatacagaaacctcaccaaaagttgaatcatctgtactaaaccactgcttttttatccagactttttatataaatcttttattttccaaaaaactgatcttttacctacccctcttagagttaaaaatattgcctgtcaggcaagagtatagtatgccaatataaataatatgctttatttggttagaaacagttggtttgggaagctagcaacatagcatattctttacaaatttaataaggtgtattttgatactgtgataacctgcattgtaaattaccaaatggttggaattgaccagtttatacttattaaaatttttgatgtgccaatggctatccaattcattgcatttgtgaattgtgcttttagaaaaattgtggacattttagttttatatacatatttatgagttatttgtgcatatgataaaattatatataataataaaagtatatatgtaactt

SEQ ID NO: 81325 - DNA, 839 bp, Homo sapiens
ttgttgttgttttgaggcagagtcttgctctgtcgcccaggctggagtgcagtggcacgatctcggctcactgcaagctctgcctcccgggttcacgccattctcctgcctcagcctcccaagtagctgggactacaggtgcccgccaccacgcccggctaattttttttgtatttttagtagagacggggtttcaccatgttgggctcgatctcctgacctcatgatccgcccgcctcggcctcccaaagtgctgggattacaggcgtgatgagccacctagtgctaattcatctctaaacctctgtagttggagtctcctgaaatctcagactacctcctgctttcattttctacccagggaatacactattgtcctaagttatttagccttgaaatgtcagaggcattttaggttcttcatgtttctcccactttcagttgattaccattacaggatcttaggcttctttttatctttttgcagtgccttgcatccactggttgttgttttactctgttgggcactacttatttccttacctctggtttcttctcctacagcttatgttctgaaatgtgtattcctaaaatactgttttcctcttgttacttttctgctcgaggacttccagtaacttaccattgtttataaggtgatgttcaaacccttcagtctggagactttctgccacctatctgactgtacctttatcttcaagcttatctctttccaaacaagaggctcatttagcagctttctctgattgccatgttcatcctacactcagcctcattcagtttacagcatggaaactgtataggacctctttcctata

SEQ ID NO: 81326 - DNA, 1651 bp, Homo sapiens
gagttagaaagcaggataaagtcggtatcctcggggaacgtgcgggcaccatgcgtccccacctgtcgccgccgctgcagcagctactactgccggtgctgctcgcctgcgccgcgcactcgactggagcccttccccgactatgtgacgtgctacaagtgctgtgggaagagcaagaccagtgcctgcaggaactctccagagagcagacaggagacctgggcacggagcagccagtgccaggttgtgaggggatgtgggacaacataagctgctggccctcttctgtgccgggccggatggtggaggtggaatgcccgagattcctccggatgctcaccagcagaaatggttccttgttccgaaactgcacacaggatggctggtcagaaaccttccccaggcctaatctggcctgtggcgttaatgtgaacgactcttccaacgagaagcggcactcctacctgctgaagctgaaagtcatgtacaccgtgggctacagctcctccctggtcatgctcctggtcgcccttggcatcctctgtgctttccggaggctccactgcactcgcaactacatccacatgcacctgttcgtgtccttcatccttcgtgccctgtccaacttcatcaaggacgccgtgctcttctcctcagatgatgtcacctactgcgatgcccacagggcgggctgcaagctggtcatggtgctgttccagtactgcatcatggccaactactcctggctgctggtggaaggcctctaccttcacacactcctcgccatctccttcttctctgaaagaaagtacctccagggatttgtggcattcggatggggttctccagccatttttgttgctttgtgggctattgccagacactttctggaagatgttgggtgctgggacatcaatgccaacgcatccatctggtggatcattcgtggtcctgtgatcctctccatcctgattaatttcatccttttcataaacattctaagaatcctgatgagaaaacttagaacccaagaaacaagaggaaatgaagtcagccattataagcgcctggccaggtccactctcctgctgatccccctctttggcatccactacatcgtcttcgccttctccccagaggacgctatggagatccagctgttttttgaactagcccttggctcattccagggactggtggtggccgtcctctactgcttcctcaacggggaggtgcagctggaggttcagaagaagtggcagcaatggcacctccgtgagttcccactgcaccccgtggcctccttcagcaacagcaccaaggccagccacttggagcagagccagggcacctgcaggaccagcatcatctgagaggctggagcagggtcacccatggacagagaccaagagaggtcctgcgaaggctgggcactgctgtgggacagccagtcttcccagcagacaccctgtgtcctccttcagctgaagatgcccctccccaggccttggactcttccgaagggatgtgaggcactgtggggcaggacaagggcctgggatttggttcgtttgctcttctgggaagagaagttcaggggtcccagaaagggacagggaaataaatggtgcctgggatgagattcaatcta

SEQ ID NO: 81327 - DNA, 771 bp, Homo sapiens
tttctcactgcagcatgtagcaaattagactggccacctggagacccaggtcctcattcaggttatgctcacagaatgtgttacccggaaagagctgaagtctagggcctcagtttccccagtgcactggtggcaggtgggcctggctgagtcccagcccctcaggctctggcctctatgtccctacattctctccctgcaggaggctccactgcactcgcaactacatccacatgcacctgttcgtgtccttcatccttcgtgccctgtccaacttcatcaaggacgccgtgctcttctcctcagatgatgtcacctactgcgatgcccacagggtaatatgtctgggtgccccaggatgtcgccaggcccgcctgccttccccagcctagctttggagaggggagtagcctagttgtccttcccccaagcccctgctgaggctgcacttaataccaaggataaagcagccagtgctgacactgggccaggaggttcagggagattccacagccacatgtgcacaatctgggtcatgtaggagagaagctcatgggggttgccgtaaactcccagtgtccaggagtgaactggtcactctaggaattagatatatagggagactcctcttttccctacttctgccagttcccagctgaagaaagatgacccagtctggagagggtgggggttggtcataaaaagaaaagggtgagcatgggccagtatgtctgtataaatgtatttgcaataaaacgttgtgttttctta

SEQ ID NO: 81328 - DNA, 1300 bp, Homo sapiens
tttctcactgcagcatgtagcaaattagactggccacctggagacccaggtcctcattcaggttatgctcacagaatgtgttacccggaaagagctgaagtctagggcctcagtttccccagtgcactggtggcaggtgggcctggctgagtcccagcccctcaggctctggcctctatgtccctacattctctccctgcaggaggctccactgcactcgcaactacatccacatgcacctgttcgtgtccttcatccttcgtgccctgtccaacttcatcaaggacgccgtgctcttctcctcagatgatgtcacctactgcgatgcccacagggcgggctgcaagctggtcatggtgctgttccagtactgcatcatggccaactactcctggctgctggtggaaggcctctaccttcacacactcctcgccatctccttcttctctgaaagaaagtacctccagggatttgtggcattcggatggggttctccagccatttttgttgctttgtgggctattgccagacactttctggaagatgttgggtgctgggacatcaatgccaacgcatccatctggtggatcattcgtggtcctgtgatcctctccatcctgattaatttcatccttttcataaacattctaagaatcctgatgagaaaacttagaacccaagaaacaagaggaaatgaagtcagccattataagcgcctggccaggtccactctcctgctgatccccctctttggcatccactacatcgtcttcgccttctccccagaggacgctatggagatccagctgttttttgaactagcccttggctcattccagggactggtggtggccgtcctctactgcttcctcaacggggaggtgcagctggaggttcagaagaagtggcagcaatggcacctccgtgagttcccactgcaccccgtggcctccttcagcaacagcaccaaggccagccacttggagcagagccagggcacctgcaggaccagcatcatctgagaggctggagcagggtcacccatggacagagaccaagagaggtcctgcgaaggctgggcactgctgtgggacagccagtcttcccagcagacaccctgtgtcctccttcagctgaagatgcccctccccaggccttggactcttccgaagggatgtgaggcactgtggggcaggacaagggcctgggatttggttcgtttgctcttctgggaagagaagttcaggggtcccagaaagggacagggaaataaatggtgcctgggatgagattcaatcta

SEQ ID NO: 81329 - DNA, 354 bp, Homo sapiens
ccaacagatgtgccatctgctccagagaaatccagacctttacttgcaaagcttataggagagggcgccttccttctttccttcttcccttcctccctccctttcttacttccttctatcttcaacactgagcactaccgtgtacatggcagagtccaagggtgcattagacaggataggttcctgatcctgaggagtcagcacctaatgagagctttgaaagtagtctagtgggaattccaggcaggcaagggtgtcggtgatgtggacaggatggtagggcagccctcggtccatcccccatccttgtctgatgctgcttttcttggcaggttgtgaggggatgtgggacaa

SEQ ID NO: 81330 - DNA, 461 bp, Homo sapiens
actgatggaggtgcatgatcagaaagtttggggctttgccatgagtcaaaaattgttgtatctgagtgatggatatgagggagttagaaactttcaaaataaaaaatgaaaacaaaaaagtttggggtactgctagccagcctcagcagtcagtcccgagctggggagtggcacagctgtgtgcctacaggaggagaaagggcgcagggaggcagagtggaggctacaggctttctgtgtccccaggcgcctggccaggtccactctcctgctgatccccctctttggcatccactacatcgtcttcgccttctccccagaggacgctatggagatccagctgttttttgaactagcccttggctcattccaggtaagtttccaggactggggctgccagctgaaaagaggagttctctgtgtccttagggagaagtggagggcatagagactgcgagcca

SEQ ID NO: 81331 - DNA, 1709 bp, Homo sapiens
acgaggccggccggagcccgggaccctgcgcggggcgctgagctcccgagcgggcagagggcacgggcaggcggacgtcggggcgccctcggggaacgtgcgggcaccatgcgtccccacctgtcgccgccgctgcagcagctactactgccggtgctgctcgcctgcgccgcgcactcgactggagcccttccccgactatgtgacgtgctacaagtgctgtgggaagagcaagaccagtgcctgcaggaactctccagagagcagacaggagacctgggcacggagcagccagtgccaggttgtgaggggatgtgggacaacataagctgctggccctcttctgtgccgggccggatggtggaggtggaatgcccgagattcctccggatgctcaccagcagaaatggttccttgttccgaaactgcacacaggatggctggtcagaaaccttccccaggcctaatctggcctgtggcgttaatgtgaacgactcttccaacgagaagcggcactcctacctgctgaagctgaaagtcatgtacaccgtgggctacagctcctccctggtcatgctcctggtcgcccttggcatcctctgtgctttccggaggctccactgcactcgcaactacatccacatgcacctgttcgtgtccttcatccttcgtgccctgtccaacttcatcaaggacgccgtgctcttctcctcagatgatgtcacctactgcgatgcccacagggcgggctgcaagctggtcatggtgctgttccagtactgcatcatggccaactactcctggctgctggtggaaggcctctaccttcacacactcctcgccatctccttcttctctgaaagaaagtacctccagggatttgtggcattcggatggggttctccagccatttttgttgctttgtgggctattgccagacactttctggaagatgttgggtgctgggacatcaatgccaacgcatccatctggtggatcattcgtggtcctgtgatcctctccatcctgattaatttcatccttttcataaacattctaagaatcctgatgagaaaacttagaacccaagaaacaagaggaaatgaagtcagccattataagcgcctggccaggtccactctcctgctgatccccctctttggcatccactacatcgtcttcgccttctccccagaggacgctatggagatccagctgttttttgaactagcccttggctcattccagggactggtggtggccgtcctctactgcttcctcaacggggaggtgcagctggaggttcagaagaagtggcagcaatggcacctccgtgagttcccactgcaccccgtggcctccttcagcaacagcaccaaggccagccacttggagcagagccagggcacctgcaggaccagcatcatctgagaggctggagcagggtcacccatggacagagaccaagagaggtcctgcgaaggctgggcactgctgtgggacagccagtcttcccagcagacaccctgtgtcctccttcagctgaagatgcccctccccaggccttggactcttccgaagggatgtgaggcactgtggggcaggacaagggcctgggatttggttcgtttgctcttctgggaagagaagttcaggggtcccagaaagggacagggaaataaatggtgcctgggatgagattcaatcta

SEQ ID NO: 81332 - DNA, 850 bp, Homo sapiens
gtagagtcctgtagcccagcccatgggtatggttcagcatagggggacagaggagggaaggcacatggggacacacaggaatcatctcatggatggaagcagtcccttggctggaagtaacatccacacggacagcccagggatgcccaaggctgcagaaccagttgaaaattaatttcatccttttcataaacattctaagaatcctgatgagaaaacttagaacccaagaaacaagaggaaatgaagtcagccattataagcgcctggccaggtccactctcctgctgatccccctctttggcatccactacatcgtcttcgccttctccccagaggacgctatggagatccagctgttttttgaactagcccttggctcattccagggactggtggtggccgtcctctactgcttcctcaacggggaggtgcagctggaggttcagaagaagtggcagcaatggcacctccgtgagttcccactgcaccccgtggcctccttcagcaacagcaccaaggccagccacttggagcagagccagggcacctgcaggaccagcatcatctgagaggctggagcagggtcacccatggacagagaccaagagaggtcctgcgaaggctgggcactgctgtgggacagccagtcttcccagcagacaccctgtgtcctccttcagctgaagatgcccctccccaggccttggactcttccgaagggatgtgaggcactgtggggcaggacaagggcctgggatttggttcgtttgctcttctgggaagagaagttcaggggtcccagaaagggacagggaaataaatggtgcctgggatgagattcaatcta

SEQ ID NO: 81333 - DNA, 331 bp, Homo sapiens
tgtagagactgttttgccatgttgcccaggctggtctctaactcctgggctcaggtgatctgcccaccttggccttcagaagtgctaggattacaggtgtgagccaccgagctggccccaaaacttttttaatgtttaagttttaccactgtactaaggaggagttacccatttttttaattgccttttttcttccttcttattagggaggggtaaggaagaagactttgtcagcagaaagcaggtcttaattgcttttttgtttgtttgttttgttgctattgagttgtttgagttccttatatgtattggatattaaacccttgtcaga

SEQ ID NO: 81334 - DNA, 137 bp, Homo sapiens
gtgtgttggtcaggtcctgaggaacgacccctcatctccacactcagcctcctccagaaagagctccttgcattggctctgggacttgtttccataaccttttatggtgaccgattcctagactctattctgttatc

SEQ ID NO: 81335 - DNA, 596 bp, Homo sapiens
gccaggcaccattcatgggaatcaacttttatccctgtccaagaacatggttcacttgagaaacttcatgcatgtgcagctttaagtgacctagtgtcagtgtcttagactagagaggttggggctggatcatgaagggtcttgtaagccatacttagtttagactttatgtgcagtgaataaatggagggagcacatggaggaaattgttctgcagaattttaaataaaaagagtgatatgatcagttttacatttgggacagataactgaaaatattatgaaaaaggtcctggagaaagggagaatgttggaggcaaagaatccagagaaaagctgagtagggtttaagctaaggttaattgcagggagaatgtagaagaaatatttaggcagtaaaatgcttaggaccagtctggacaacaaagcgagaccctgtctctacttaaaagaaaaaaaaaaaaaattagccaagcattgagggctgcacctatattcctggctacttgggaggctgaagcaggaggattccttgagcccaggagtttgaggctgcagtgagcagcctgggcgaaaagagcaagaccctgcctctta

SEQ ID NO: 81336 - DNA, 1841 bp, Homo sapiens
aactttctgatctatgaacttctcagttcagctgtcacattatgagaagtaaatcagaatttttttaaggagaagtcattcttagcactacaataattgtaccagtaattgaggaaaccaagacaatcttcacctgaataatagagggtctgagaactgtcagccttttgccattcaaaaacatttatgtccaacctgaaaaaaaagcatcaataaaacctatcccaagcattcaaaatagtcctttccaaatgttatttattttaaagtcaatcagctcttttagaaacagattctggtctggctgaaaactcccacaacaaatttactcatccagtggctaatatttaatgcccaccatgggcagagcacacaaatcttcagataaacaatactgaattgattcagcacagattgttcagatttgaatgaccagggagttgtatttgcacatgcaagaacactaagaatctcccagtcctcaaactagaaacctttcagctatgatgaaaaaaaaaaaggggtcttcatttttccaagagggggtggaggtggggatcactttttagctaaaagctatctctcacttcaaaattcttgtctttttctttgtggacaaacaccagtagtctatcacttggagatcttttaatatctcccatcatttaaaacatccacgagagtttgaagatttgtgttgattgccagatacagaagccccttgaaaataaggaaagggtggaggaagcatttttgtgtcctatccctacttatcgtagcagctctatagacaaaagggacacttactggtgagcctctggcccttaaaagaaaatcatctaagaatatgaaggcaatttgatttccccccacagccctcagctgccttcctcacagaaggaagttcccaaaattgctggtacacagtttgcaatcaaatatcagatatgagaaaacctgtagtgaagagtctgggttcttggttttctcataaatccaatataaatttgtaggttggttcagggtcaaaattgccagtgctttattagacagatgatactgatagacacacagagcccaggtcctggaacaagacaatcctgtagtgccaagatctggtcagttgcgttaaggagctgggtttgattctagagtccaggtttatagagaaaccctggctagattgagcctacccatggggagacgatttcaagacaggatgagatctgggaagaattttgttgtcatctgccagggaaattatcacaggactcattgaatgcaataacatgtgagtaagttcccttttgattctgggaatcagcgattttccctgtggattaagacaaaccaacgccagaaggtctcctgtgcttattttaaccatctgctcccatcgtgaaccctggagcatgcatttcctagaagtggtttcatagctcctgtgtgttcatggaaaaggggagtataatgatggggatgctggaagcttttttaatgttttccaaaggaaaggaacccacactgctccccagagttcctttccaatggccctgcagtaagaacggaggacaatgtattgctgggtgcttaaaatcctccctcagtgaagcacaaagagacactttgtaaagaaaaaaagagcaagcataggttctctgtgggaccttgtggagtggtgttttcacgttggtctctttggctcaattgagcataatcagaaagaaatgtgggttattgggaagagacaaaaagcagtggctaaaataccaaagttggcatgtgttctttttttaaaaaaaaaaaaatgcatatatttttaaataaaatgtttattttaa

SEQ ID NO: 81337 - DNA, 1803 bp, Homo sapiens
aactttctgatctatgaacttctcagttcagctgtcacattatgagaagtaaatcagaatttttttaaggagaagtcattcttagcactacaataattgtaccagtaattgaggaaaccaagacaatcttcacctgaataatagagggtctgagaactgtcagccttttgccattcaaaaacatttatgtccaacctgaaaaaaaagcatcaataaaacctatcccaagcattcaaaatagtcctttccaaatgttatttattttaaagtcaatcagctcttttagaaacagattctggtctggctgaaaactcccacaacaaatttactcatccagtggctaatatttaatgcccaccatgggcagagcacacaaatcttcagataaacaatactgaattgattcagcacagattgttcagatttgaatgaccagggagttgtatttgcacatgcaagaacactaagaatctcccagtcctcaaactagaaacctttcagctatgatgaaaaaaaaaaaggggtcttcatttttccaagagggggtggaggtggggatcactttttagctaaaagctatctctcacttcaaaattcttgtctttttctttgtggacaaacaccagtagtctatcacttggagatcttttaatatctcccatcatttaaaacatccacgagagtttgaagatttgtgttgattgccagatacagaagccccttgaaaataaggaaagggtggaggaagcatttttgtgtcctatccctacttatcgtagcagctctatagacaaaagggacacttactggtgagcctctggcccttaaaagaaaatcatctaagaatatgaaggcaatttgatttccccccacagccctcagctgccttcctcacagaaggaagttcccaaaattgctggtacacagtttgcaatcaaatatcagatatgagaaaacctgtagtgaagagtctgggttcttggttttctcataaatccaatataaatttgtaggttggttcagggtcaaaattgccagtgctttattagacagatgatactgatagacacacagagcccaggtcctggaacaagacaatcctgtagtgccaagatctggtcagttgcgttaaggagctgggtttgattctagagtccaggtttatagagaaaccctggctagattgagcctacccatggggagacgatttcaagacaggatgagatctgggaagaattttgttgtcatctgccagggaaattatcacaggactcattgaatgcaataacatgtgagtaagttcccttttgattctgggaatcagcgattttccctgtggattaagacaaaccaacgccagaaggtctcctgtgcttattttaaccatctgctcccatcgtgaaccctggagcatgcatttcctagaagtggtttcatagctcctgtgtgttcatggaaaaggggagtataatgatggggatgctggaagcttttttaatttcctttccaatggccctgcagtaagaacggaggacaatgtattgctgggtgcttaaaatcctccctcagtgaagcacaaagagacactttgtaaagaaaaaaagagcaagcataggttctctgtgggaccttgtggagtggtgttttcacgttggtctctttggctcaattgagcataatcagaaagaaatgtgggttattgggaagagacaaaaagcagtggctaaaataccaaagttggcatgtgttctttttttaaaaaaaaaaaaatgcatatatttttaaataaaatgtttattttaa

SEQ ID NO: 81338 - DNA, 507 bp, Homo sapiens
tttttttttaatttgccaggcatggtggtctgtgcctgtagtctcagctacttgggaggctgagaagggaggatcacttgagcccaggagttcaaggctgcagtgaccagcgcactccagcctgggcaacagagtgagatcctgcctccacaaaaacaaaaaacaaaacaaaaacaaagttgcaggtaggtgggtaaggagagaaagaaatctcaaaagtctcaccctaaagcagacaacctagactaaatcacatttcaaaatattttaaaatacctataagccggccgggcgcggtggctcatgcctgtaataccagcactttgggaggccgaggcaggtggatcacggggtcaggagttcaagatcagcctggccaagatggtgaaaccccgtctctactaaaaatacaaaaaattagctgggtgttgttgtgggcaccttgtaatcccagctactagggaggctgaggcagagaattgcttgaacccgggaggcagaggctgc

SEQ ID NO: 81339 - DNA, 629 bp, Homo sapiens
cggatgggggatggggcaggatggggcaggacaccgatatgctaaatacctaccaacagttggttaggaccccgtcggtgcgaccagggcaggacgtgcggctccaggctccaggaaccagaacggggctgctcaagctgctgtcgaccgtctctcaggacaagcaggtgagggaggcccagtgaggacacttccagctgcctagagccagggctgcctggggagtggtgatggtgtgccaaatcaagacctgcagcagaggtctcagagctcaaggcagacagcaaagaaggaccgcaagcccaggggccagagcaagaaaggacagggctctgaagagtctgaagagtaagcagcagtgggatgggtcaggaggctgttgggggtcagggccctctggggctggcgccgaccctgacccccaccctttccttcttcagtcacttcccgcttcttcctcggaaaccctccttccccttccagtgggcctgggagagcatcgccacagatgtccgggctgtgcttcagccaagctccccaacccctggccaccaagccctgcccatgccctcctcgttctcccagcgtcagtccaggcgcaagtccacggccaacctcccagaggccca

SEQ ID NO: 81340 - DNA, 476 bp, Homo sapiens
ctgggaacatgggagatagatctagagatgtagtgtgaaacttatcccatgggatgacagttgggacagtggaattgtatgtaccaggaaagagatagcaaaacagtattgagagagaacgagttctgaggagacagaacctgggaacatcctgtggagaaccaatcaatgttcttccactccttgatagaaagcacgtttcttcatcaagtcaatacaacaaacctaaccccagaaatatgctcttgtggctaagaagttaggacacaccaaagagataatgtccatttagacatccatttctccttgactctgtcacttctatgtgtgaagcagaattagaccaaagccacgtatgattttgtataatagctggtctatttggtttcctcagaaaggtctttaataagtaccagtgatacgtataaaatacgtatgggtggcttcccaagtgaactgccagtccctcaaatctt

SEQ ID NO: 81341 - DNA, 537 bp, Homo sapiens
ggcaggcgactccactgggcgccatcttcggggaacgactcagcgcaggattgtaaatacaccgctggggtggggcggggaggacggtggcctgcaggacgcaaaaagcggaagccgaagcatgaggcctgcgaccgttaggcgggcgcgcgctcagggattagccccgccccgtccgtgcccccggcgcgcgcgctcccccattctcccgctcggcaacgacggcggccttgtgcgcgtgcgcgcgaaataacggccgctggcggagggagggggagtggaatcgttggcggggggaagaggagagaagccgccctgtctcccgcgcgcccaccacctgcgccatcgtcagccaatcagcagccgtctcaggggtctcgcgctcggggcgactcgggctgctgggtggctcccccgtccctcctcccgccagagtccctctcgcgcctgcccctcccgctggccacgcgcgcgctcgcgctagcgctcgcgcccgctccagcctcttgtgtgtcctcgcgccccccgcccgccctc

SEQ ID NO: 81342 - DNA, 518 bp, Homo sapiens
tgctgaagtgacagctgattatacaacctgggagaagcgcggcacaccaggatctgacacttcccagggctctggccctcgccttctctcccttttgctccccagcatgggctgccttcctccttctccatgtgcccctgggttagggggaggctcctgtgtttagtctcctcttcccagctcccgtggaacaagacaaaatagccgttttcaccaaaagccagagtctcagcgcttttaatgtgatgtgaacagtccctgagactgtgatgctgttggggagacatcttccttcatggcacccactgcattgaaccctctgccaatagaagatcctgctcagaagcggggacccaaaccaaggcagtgacagcagcacactcagaccaggaacgccttctgaggcctcccccaaatcatcctcctcgtcctcctctgagcatgtcccacaccaggccccaacctgaacgcttcatcaaagatgaatgttggaatccaactcacaggcttcacatctg

SEQ ID NO: 81343 - DNA, 386 bp, Homo sapiens
cttttcctttgaattgtaatatgggagcagtaatatctgagtcacacccgggcagtgtaacctgctcctgagttaaacatacagtattagtttgccaatggcttgcctggctcttagggacttaaaagttcttgaactccatatgatcactccaggtaactagtaaggtaattaatatctctttaaatccccagaccagaactgctgctgttctccatccaccaactacagtggtctccatctaggagacccatcatatttaaacaacaccccgggccaggcacggtggctcacgcctgtaatcccagcactttgggaggctgaggagggcggatcacccgaggtcgggagttcaagaccaccctgaccaacatggagaaaccccc

SEQ ID NO: 81344 - DNA, 1494 bp, Homo sapiens
cggccgcggagcagcgaacgcgtgcctgccagggaaaagcagtcaccaggaacgcggcgttttggtcggctgcccatcgccagccctgtccgcgcgagatgccctgctccgaagctcttgtgagctccgcggcctgcggctccggaaggcgaagctcttccaggaagcagcggcggccccactggccctctcaggctgcggagaaagggcgggaggccgcggggctctccaggactcagtggtttcggagaaactcgacttcccaggctcggagggccagtttgggattgttatagaacaaaacgtgggcggcataaagtgctccgaagtggagatcaccttgaagactgggcccttggctctgtgacccagcagacccgaaattccaatctggcaaactttcagcctgacccttgggaaaggatcgctcccagagtgtgggggtggaggtgatgggacaaagatcttaaaatcctgaaaaacaaccgttattctcaactgaatttctgctaagtgcatccattcataaacagtacgtgcctggcgctctttacgtgtattaactggtttaattcccacaaccttaagtaggggctgttaatctcacaattgtagagccaccattcaaagccaggcagtctggccccagcctctgtgggcttaaccactacccgccgccaagcagctcctaggagcctggcagggaaaggcatggtgacgacagcagacgaggtccctcaagtagcttgcattctggaagcgaagaaagatcatgaacaagtttcaaattggtaaaataattgtcagtggagattcatcccataaaggaattgagtaaaaggaagaactactttcagtaagatggtttgggttggagtttctgttcataagggcagaaatggactctctctgacttaaagagaaaaaactttgttaagagtttggggtaacccacagaattatcaggatgtctcagaatacagacaagaacaaagggaggctccgcagccaaaagtccctcctctaaaccactttgatgaggaccaaacaggtgctactgctgaaagctagacaccacatcctactccacaaccaacgctggaactccccagacaccccgctggctctgccgcccctaaaccggatgcggcagccaccgcggaccccacagcggattctccaccaccccatttctttgcattgcatcaccacctccagagtgtgcctaattggcaccccgctgcttctgatgcaaaactccaagctgtactgggcaaacgcgcagcctctggcaccattcccagtgctgctgagcatacagacctgagcacagcggagggggagggcttggtggggagggggacttacaattcatccacgctgttgaaatcccatcaaacacacacgacccagtttggctggtgcagccttttctctcccctcctgatagcatttcagcctctcttccaataaaaaatagtagctactaaaaaa

SEQ ID NO: 81345 - DNA, 1551 bp, Homo sapiens
  misc_feature (1462)..(1462): n is a, c, g, or t
  misc_feature (1470)..(1470): n is a, c, g, or t
acttccgtcggcccgttgggaatccggcccctgggtggtccggaaacgattctggacctgcgggtatatccagggcccgcaccccctgggattgtgggaaatgtagttttttgcctccgtaagggaccaggcggagctgaggaaccgcgcgaggactgggaccgtgattccactaaccggaaaccgtcgcctttcgggcccggcggggcctgagccaatgcagaagcgggggccgcgaggacgccagcgggcgctgtgcgtaggaaccgccgggtggccgctgccgatcggggccgacttggggacggaccggaagtgcccgagggcggccgcagaacggtcaatttgagccgcgtcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggtaggaagccccgcgggggcggatgggaggatgcacacctggttaggagtgcgggtctcagcagctccgctggggcagggccggtggccacacacacactctttcccctctaagcttccgatgctcacagagggaacctcaggggttcaggccaggaatgaggtgcgggggatcctcgctgggacgaacctgctgctcctcaacccgacgggcctgtgtggtctcgcgagcggtgaccgtggcgtctggttttctgcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgccttcccgcccgttgctgctgtgatcgagaataattcaggntcgaaaanaaaagtgggatattatgggggaagaagtaaggaagagaagaatggacgttgtgaggaactgggacaagagagaaaaaggtg

SEQ ID NO: 81346 - DNA, 591 bp, Homo sapiens
cgcagaacggtcaatttgagccgcgtcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcggtgcgtccgagcgcgacaccgcccgcgtcgggggcttgggagcctcggggcgcgagctgtgttggaagcaaagtcctccttgtgggttggggtggcggagggagaagggaagcgagggtcgcggcgggaccagacgccccagtcccggcccgcccgcgactactgaaggcgctgccgcctgacctgaacgggcacttgtgttccagctcccctgggacctgtggccgccgcccacagaccatgctcctggggcgcctgacttcccagctgttgagggccgttccttgggcaggtaggaagccccgcgggggcggatgggaggatgcacacctggttaggagtgcgggtctcagcagctccgctggggcagggccggtggccacacacacactctttcccctcta

SEQ ID NO: 81347 - DNA, 1135 bp, Homo sapiens
  misc_feature (1046)..(1046): n is a, c, g, or t
  misc_feature (1054)..(1054): n is a, c, g, or t
acttccgtcggcccgttgggaatccggcccctgggtggtccggaaacgattctggacctgcgggtatatccagggcccgcaccccctgggattgtgggaaatgtagttttttgcctccgtaagggaccaggcggagctgaggaaccgcgcgaggactgggaccgtgattccactaaccggaaaccgtcgcctttcgggcccggcggggcctgagccaatgcagaagcgggggccgcgaggacgccagcgggcgctgtgcgtaggaaccgccgggtggccgctgccgatcggggccgacttggggacggaccggaagtgcccgagggcggccgcagaacggtcaatttgagccgcgtcgagctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgccttcccgcccgttgctgctgtgatcgagaataattcaggntcgaaaanaaaagtgggatattatgggggaagaagtaaggaagagaagaatggacgttgtgaggaactgggacaagagagaaaaaggtg

SEQ ID NO: 81348 - DNA, 1292 bp, Homo sapiens
  misc_feature (1203)..(1203): n is a, c, g, or t
  misc_feature (1211)..(1211): n is a, c, g, or t
acttccgtcggcccgttgggaatccggcccctgggtggtccggaaacgattctggacctgcgggtatatccagggcccgcaccccctgggattgtgggaaatgtagttttttgcctccgtaagggaccaggcggagctgaggaaccgcgcgaggactgggaccgtgattccactaaccggaaaccgtcgcctttcgggcccggcggggcctgagccaatgcagaagcgggggccgcgaggacgccagcgggcgctgtgcgtaggaaccgccgggtggccgctgccgatcggggccgacttggggacggaccggaagtgcccgagggcggccgcagaacggtcaatttgagccgcgtcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgccttcccgcccgttgctgctgtgatcgagaataattcaggntcgaaaanaaaagtgggatattatgggggaagaagtaaggaagagaagaatggacgttgtgaggaactgggacaagagagaaaaaggtg

SEQ ID NO: 81349 - DNA, 479 bp, Homo sapiens
aatcctccctaactcattttatgaggccagcatcatcctgataccaaagcctggcagagacacaaccaaaaaagagaattttagaccaatatccttgatgaacattgatacaaaaatcctcaataaaatagtggcaaactgaatctatatgactttagtgtaatatcattgaagacttagagagggttagtgtgagttagaaaaactctctatttttaatattctgcccagtctaaaatttttacctgtcataaactaaatctgtatatctctcacctgtcttatatttatttcagtacatgatataagggtggactctatttttttctcaatggcgagcccatcatctcatctccatttattagataatccatttttttctcactgattgtggataacacatatacatatttgcgcttttaggatttagtctttttttcccctttgacctttctgtactctagcattaacaccacatg

SEQ ID NO: 81350 - DNA, 272 bp, Homo sapiens
gcaggaacccttggcctgccattttcatgttcaggtcttgatccttggtaaataatgaaagccaggcccaaacacgtagctacttttttttattttgtttttgtttttgtagagacggggtctgatacggtttggctctgtgtccccaccgaaatctcatcttgaattgtactcccataattctcacgtgttgtgggagggacccaatgggaaatattttgaatcatgggggcagtttcccccatattgttctcatggtagtgaatatgtct

SEQ ID NO: 81351 - DNA, 224 bp, Homo sapiens
atggtttttgccatgttgcccaggccagtcttgaacttctggcttcaagtgttccgcttgcctcagcctcccaaatgctgggactacaggtatgagccactgcacctggctaaaaacttcacttttctaatctcttatttaattttgtggtagaaatatttgagttttataatgttgttttttctttttctttttgtttttttctttgagacagggtcttgctc

SEQ ID NO: 81352 - DNA, 422 bp, Homo sapiens
catcatcattatacattatttttccaggcacaaaaggctcattcttatagaagtcattatattcttccccaaaaacaaaagcacatgctttttttgaaaaatggaaaacttgggaaatatagagaagattaaagaggaaaataaaaatcatccataatccttttggtcagagataactgttgttaatattttgcatatattttttttcattcttaatgactaaatttatgttgcacattactttcttgccagtaggcacacatgcatatttttaacatttgtaatcttagcaaacacagttaaatattctttctccaaatatctacagccttcataattattttaagactgagtaatacttcaacatgttgatgtaccataatttattaaactactttccctttatggaaggaaaatctatg

SEQ ID NO: 81353 - DNA, 368 bp, Homo sapiens
ggtacctacaagaaagaattaaaagagaaagttgtgacttagtgcagtggagacacacacaatcatggtatgtggagctagcttgaatcaaatatggaagaagctggctaaatttttgagagacatgccaaaatagctatcagtcaagactaaaggaaactgtaaatagactccaagtgggagtggggcttcaaccttctgtggacagagttgtctgagaacgctgctcagactttaaggagatcacattttccagtgctcacttaaggacaaggaggccgggtatagtggctcatgcctgtaatcccagcactttgggaggtcgaggcgggtgaatcacgaggtcaggagtttgagaccagcctggc

SEQ ID NO: 81354 - DNA, 6452 bp, Homo sapiens
gaaattttgagaagtggtgggatgaagaagatccctgaagagaggagtaactgagacaaaggcgaggctagcaatagagagacaagtgagggaattagacctttggtatcatcatgaaaaggcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcaaggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctaggcccaagggctagtcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaaaaaaaggcctttgagcatatgggtccagccactcagaagtgcaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcaccccagaaccagctgccgtgtccatcttgtcttgaggggcttggtggtggaacccgttctcactccagtctgttccaatttttgctttatttggaaataattgggtatttttcttggctgtgaataagaacaaatgctctctacctcagcgtctgttgtaaagtggaaatcatactagcatttacccatccagctttcttaggcgtctagagatgggttctgggcgtgtctgtctgctgctttcacaggtcacttagatgtgacatcttgagggtctgtgacattgggcccaaactccacaccaccatcacagcaggcagcccctggggaaggaggtaggtaaaggcttgagagctgcctcccaggtgcatcctctccacgggcagcatcacccagccctcagt

SEQ ID NO: 81355 - DNA, 406 bp, Homo sapiens
gggttagcacaggtttggaagtcagaaaacagacctgattcccatcactcaacagctgtgcagccacaggcaaagtcacttctctgaaagtaaagtgaaccacagtttcatctttgctttaaacagtatcaacagtaatcatacctaccttacaggattgtcatgaggattaaaatgaaaacatgaaaagtccttagcatggtgcatgtgtcagagtagggctcagggaaacagtgttcttactcccagaggtgtttttctgggtggtgggttagtctgttttctgcagtcactcacagttttttcctcctcgtgacagcaaaacccagtgtctgcatctccaagacatcgagacatgatcagctaatgatagcgttagcatcagaaccagcaatccaccgacgca

SEQ ID NO: 81356 - DNA, 501 bp, Homo sapiens
ataaagagctaactatctaaatatatatgcacccaaatacaggagcacccagattcataaagcgagtccttagagaactacaaagggacttagacgcccacacaataataatgggagactttaacaccccactgtcaacattagacagatcaatgagacagaaagttaactaggatatccaggaattgaactcagctctgcaaggaacccacgcgcgtgggttccttgcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatggtgagtccttcgggcttcgc

SEQ ID NO: 81357 - DNA, 3107 bp, Homo sapiens
ggcggtacctcggctctaccttgtcttgcctgaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaaaaaaaggcctttgagcatatgggtccagccactcagaagtgcaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcaccccagaaccagctgccgtgtccatcttgtcttgaggggcttggtggtggaacccgttctcactccagtctgttccaatttttgctttatttggaaataattgggtatttttcttggctgtgaataagaacaaatgctctctacctcagcgtctgttgtaaagtggaaatcatactagcatttacccatccagctttcttaggcgtctagagatgggttctgggcgtgtctgtctgctgctttcacaggtcacttagatgtgacatcttgagggtctgtgacattgggcccaaactccacaccaccatcacagcaggcagcccctggggaaggaggtaggtaaaggcttgagagctgcctcccaggtgcatcctctccacgggcagcatcacccagccctcagt

SEQ ID NO: 81358 - DNA, 6024 bp, Homo sapiens
  misc_feature (5959)..(5959): n is a, c, g, or t
  misc_feature (5993)..(5993): n is a, c, g, or t
  misc_feature (5996)..(5996): n is a, c, g, or t
atgagcggcggcggcgacgtggtgtgcaccggctggctgaggaaatcgcctcccgagaagaagttgaggcgctatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcaaggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctaggcccaagggctagtcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaaaaaaaggcctttgagcatatgggtccagccactcagaagtgcaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtactaactgcaggtgcagtccctcttctantctcgtatagactgccttgtgaggggcccgagcnccnacatgaatagtacacacatatagatgta

SEQ ID NO: 81359 - DNA, 5800 bp, Homo sapiens
  misc_feature (5753)..(5753): n is a, c, g, or t
atgagcggcggcggcgacgtggtgtgcaccggctggctgaggaaatcgcctcccgagaagaagttgaggcgctatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcaaggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctaggcccaagggctagtcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaaaaaaaggcctttgagcatatgggtccagccactcagaagtgcaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtctgtataangcgtcggtaccattaaatacataccgtcgcggggggggcgggtccgt

SEQ ID NO: 81360 - DNA, 5863 bp, Homo sapiens
atgagcggcggcggcgacgtggtgtgcaccggctggctgaggaaatcgcctcccgagaagaagttgaggcgctatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcaaggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctaggcccaagggctagtcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaaaaaaaggcctttgagcatatgggtccagccactcagaagtgcaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaacacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcaccccagaaccagctgccgtgtccatcttgtcttgaggggcttggtggtggaacccgttctcactccagtctgttccaatttttgctttatttggaaataattgggtatttttcttggctgtgaataagaacaaatgctctctacctcagcgtctgttgtaaagtggaaatcatactagcatttacccatccagctttcttaggcgtctagagatgggttctgggcgtgtctgtctgctgctttcacaggtcacttagatgtgacatcttgagggtctgtgacattgggcccaaactccacaccaccatcacagcaggcagcccctggggaaggaggtaggtaaaggcttgagagctgcctcccaggtgcatcctctccacgggcagcatcacccagccctcagt

SEQ ID NO: 81361 - DNA, 1853 bp, Homo sapiens
atgagcggcggcggcgacgtggtgtgcaccggctggctgaggaaatcgcctcccgagaagaagttgaggcgctatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccaagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcaccccagaaccagctgccgtgtccatcttgtcttgaggggcttggtggtggaacccgttctcactccagtctgttccaatttttgctttatttggaaataattgggtatttttcttggctgtgaataagaacaaatgctctctacctcagcgtctgttgtaaagtggaaatcatactagcatttacccatccagctttcttaggcgtctagagatgggttctgggcgtgtctgtctgctgctttcacaggtcacttagatgtgacatcttgagggtctgtgacattgggcccaaactccacaccaccatcacagcaggcagcccctggggaaggaggtaggtaaaggcttgagagctgcctcccaggtgcatcctctccacgggcagcatcacccagccctcagt

SEQ ID NO: 81362 - DNA, 863 bp, Homo sapiens
ctcgataagggccaagggatgctggtccgagatgtcaccatgggagaaggggccagagggaggatgagctgagcccatgctccagtaacttcagaatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcaccccagaaccagctgccgtgtccatcttgtcttgaggggcttggtggtggaacccgttctcactccagtctgttccaatttttgctttatttggaaataattgggtatttttcttggctgtgaataagaacaaatgctctctacctcagcgtctgttgtaaagtggaaatcatactagcatttacccatccagctttcttaggcgtctagagatgggttctgggcgtgtctgtctgctgctttcacaggtcacttagatgtgacatcttgagggtctgtgacattgggcccaaactccacaccaccatcacagcaggcagcccctggggaaggaggtaggtaaaggcttgagagctgcctcccaggtgcatcctctccacgggcagcatcacccagccctcagt

SEQ ID NO: 81363 - DNA, 597 bp, Homo sapiens
atgagcggcggcggcgacgtggtgtgcaccggctggctgaggaaatcgcctcccgagaagaagttgaggcgctatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagctcgcccctgagttaaccactcgcccctgtattaaccgctcgcccctgatcacg

SEQ ID NO: 81364 - DNA, 389 bp, Homo sapiens
gttgtcaaaccctgtgtccccacttttgattctgaaaatataattaccatagatacagcagaaagaatatataatttggaatctgaagacatgacttcaaggctcatcaatatgggcaaagattatacaacctcgctgagcgtcagtttccctgtgtgaaactggaatgactttgcaggcctttataaacatgctcatgtgttatatataaggtgtgtatgtgtagcattatcattactggctgattaccagactttcttttcctgctccagcaaagccaacaccacttgacctgaggaacaacaccgtcatcgatgaactccccttcaagtcacctatcaccaagtcttggtctagggccaagtaagtgcgtatgtgtgggggtggga

SEQ ID NO: 81365 - DNA, 451 bp, Homo sapiens
agtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggtaggaggctgccacagccattaggtgggttagtgaccgctcacagggcctagtacttttcagtccttgcttttttaaagacaagcaaaacattatatcgtttcaggtagacaaacacgtctatgacaaaacataattttttgcttctgtagccttcatattttattggcatcatctgtgttgctacacagtgataactgggtgccagagaaacttttcattatcaaaaatcatgctataaaaaatgtttgatttggaggcaggggtgaaggcattaggggacacagtttccgaattgca

SEQ ID NO: 81366 - DNA, 6406 bp, Homo sapiens
atgagcggcggcggcgacgtggtgtgcaccggctggctgaggaaatcgcctcccgagaagaagttgaggcgctatgcctggaagaaacgctggtttatcctgcggagtggccggatgagcggtgacccagatgttctggaatactacaagaacgatcactccaagaagcctctgcggatcatcaacctgaacttctgtgagcaggtagatgcaggcctgacctttaacaagaaggagctgcaggatagttttgtgtttgacatcaagaccagtgaacgcaccttttacctggtggctgagacagaagaggacatgaataagtgggtccagagcatctgccagatctgtggcttcaatcaggctgaggagagcacagactccctgagaaatgtttcctcagccggtcatggcccccgctcttctccagctgagctcagcagctctagccagcaccttctccgagagcgcaagtcctcagccccatcacactccagccagccaactctgttcacgtttgaaccccctgtgtcaaaccacatgcagcccaccttgtccaccagcgcacctcaggagtatctctacttgcaccagtgcataagccgaagagcagaaaatgcaaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtgatgagagggccaccgcagagcccaggaggcagcatctccagagctggcccttcccatctcccctctcccctctcccgttcttcctcccatccacctcctctctactctgccagtctcagccttcaaagcacttgacatcagggaccctgaacccttcccctgggaggtgagggcctgatcaaggcacctcctctgcccactcggggcccagctgtgatttttatcagtaatggccatgcctccacccaccttagttaggagctacttccaaaaagcatccttcagcctcttcctgtcctttagacctgactctctaccagatgtttggagggaagggctggggctctgagccagattccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaggacaaaaggaagggaaaactgatggccaacctagagcagcaaggagcagggcttggagctcgggtggtggagatgacaaggacactgtggggtctgggtccccagaactctggagctacaggccactctaggcccaagggctagtcctcttccccagtcccctcagaggcccccgccagccccaccttgaaagcagcatacaggggaaggcttggaccaagctgggcgaccaagcacatggggcaggaacacatggtaaaggggtggggaatatgggagggagtgtggtgtggatgggggtgatgcagggactgaggggaaccctgggacaggcacaggctgggcagaggcacagggcagtgcaggggactctgcagtggggtcgggaagtgagtttctttgcagtgagcagtgcagtggaagtcgggcacagaggtagcagacagatgtgaagcagtggtgaaggccatgtagcaagtggggaaatacatccaaagggcctgggagttggggggtgcccaacgcaatccttgggggtgcagggtggagcagaaagtgaaggagggacacgtgcaagagtggtgtgcatggtggtgtgacatgaggaccgttcctaggatgggacagtgggtcaggcaggacaaggagaaagcagggcagaatgatgcctagaggaccacatcaggcatggctgacagcttgtgcccatgggctgtggcgtatgtcagatcgcagggtaggaacgagtctggcctggtgccggcccagtgtttcctcagctcatccgccctctgttgctccctagcattccaggagccatcttggactctcctccccaggtttgaaaggccatcagattagcagggacggggtgtagggcatcacccaaggttccttctcttaaactaagggtgggggatctgaatgtttttatgttgactgttcttgactaaattttcaagagtttcagaagcaacaggacagaccagacgtttcattctaccctggggcgaacagaacttcttcctcccaaacaatgacttcctgccatgtttgatggggacagctaccactgtcctctgcccccattcccctttcagctcccatgagcatgcatagttcaccagaccaatggcctagccattctctaagtcccatcctggaagaagttatttcttcaagagctgcacctctcctcctagcattagtttagatcaactcaaggagtatttattaatggctgctgtctccagtttctggggttaagcactaaggacacaagaatcaatcagaccttctccctgaacttaagatagccacaatcagaaaaaggacaaggacatgagacagtggtgatggccatcagacagagacttcaaatgctgatggagggcagaggaagtacttagggaggttggtgtcagaggcaggagtgggggatcagggaaggtggattctaggaaaagggagtgcctgaggtaggccttagaaggggatgagtcagatttttacagaggaggagggcagggcttgggtccagtggaggaagaaggaaggagaggcttggaaagccttgtgtcttgggaaaaaaaggcctttgagcatatgggtccagccactcagaagtgcaggggccatgccttggtgttccaataagtgaatggaagcagtggtggtagctacactgggcagagttggcagggtgctggttcactctgcccagccctgaatgtgtgccttaaaggccccctacaaggggccccatacgacagagcttttaactggtgccttccctgtacccgcagcagccacaagtgggcccagactattgcagcctcccataaacatgtgagcatgttctgagtgtgccatgatgtgagtggacctggctggaatcttcggagagcgactgaggtgttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcaccccagaaccagctgccgtgtccatcttgtcttgaggggcttggtggtggaacccgttctcactccagtctgttccaatttttgctttatttggaaataattgggtatttttcttggctgtgaataagaacaaatgctctctacctcagcgtctgttgtaaagtggaaatcatactagcatttacccatccagctttcttaggcgtctagagatgggttctgggcgtgtctgtctgctgctttcacaggtcacttagatgtgacatcttgagggtctgtgacattgggcccaaactccacaccaccatcacagcaggcagcccctggggaaggaggtaggtaaaggcttgagagctgcctcccaggtgcatcctctccacgggcagcatcacccagccctcagt

SEQ ID NO: 81367 - DNA, 833 bp, Homo sapiens
ccactcagccctaggtactttaggccaatctgctgatcaaggccataagtgcctcataaccaatcagcagggtaccttcccggcagcctcaagggtgactaggtttctaccacaccctgatcccaggccttcctctcagccagtcctacccagaacaccctatttcacagtgcacttcacccctagcctacctggccattccctatccccatagctggctctaagttttcttatcacctctaacctgctctaaatgctaaggatatgcatctgttgttgatttgtatttagtaggctctgcaagcagggatctttggctcttcggttcactcatgtatgttaagtgcccagaacaagcctgacagatattaggtgctcggtaagtgcgtgttgagtgagtaaacaacagacagccagtttgggtattcccagtagggcaggaacagagaagagacacgttttattgggaagctaacaaatcttaagcttcaaagttcctctttcccctgcaccagcaccttacaaaaaaaaaaaaacctactgtggttttacaatttatattttgcaaacaggctctgaaatgtatttacctcaggctccaaaaaacctggatcttccttgagggcagtgctgcctactggatgaaatacagattttagagtcagagttgggttcaaatcctagctctgcctcctgcaggtgtcttaacctctctgacccccctctcctaatttgtgcaagggaataatatccccacatgtgtaagactcaacagggtgggaagggcacatttgtatctaacctgaatattaatatatgcattccacagtttc

SEQ ID NO: 81368 - DNA, 354 bp, Homo sapiens
tattcaacaattcaccattattgaaactccagtctaggcagctatagaattctgcgattgaatcaggtgataacaaatagtcttagatggggttttgcccagtggctaagtggagattatattttcaactgggacattttgaacaatttcttgttctttttacataagcatctttttaattcttgttaatcattaatacatcttcctgaacacaggaagttttgtatttctatagctaacatttctatacctataataatatttagaattttccagataaatttcaatccttaagcaagcataagaaactaaacatcattccagtggtatacatttgggaagcttggtgtctca

SEQ ID NO: 81369 - DNA, 567 bp, Homo sapiens
gcaccaggaagagtggctctaggagggagaggagcccagggactgacccaagatgccgttgactccagagccgccctctgggcgcgtggaggggccccccgcatgggaagcagccccatggccctcactgccctgtgggccctgcatccccatcatgctggtcctggccaccctggctgcgctcttcatcctcaccaccgctgtgttggctgaacgcctgttccgccgtgctctccgcccagaccccagccaccgtgcacccaccctggtgtggcgcccaggaggagagctgtggattgagcccatgggcaccgcccgagagcgctctgaggactggtatggctctgcggtccccctgctgacagatcgggcccctgagcctcccacccaggtgggcactttggaggcccgagcaacagccccacctgccccctcagccccaaattctgctcccagcaacttgggcccccagaccgtactggaggtcccagcccggagcaccttctgggggccccagccctgggaggggaggccccccgccacaggcctggtgagctgggctgaacc

SEQ ID NO: 81370 - DNA, 585 bp, Homo sapiens
gcgcaagctctctcagggttttcagaggccccaagcccatggaatgatgccaacagagacaactggccctttgctaagctgccactgagaatctgagcagaatgagatgaacgtcagagatactctttcctcctcgatcctcacaggcaggaaatgagcagggagtgagacacagggatttgctccttctaatggaaaatgctgtcagagtcctgagtccagattctgcctctgacattgattctgtgtctggagttaaccctctgagactcatcctgggtaaggtccattctgaataaagcctaccggaggcagctgctgtgggcatcatggagatcatggatgcaaaaggagtttgtagacacaaaaatgaaaggattctcattaccctgcaacacctgggctcctagggctaaacctgacgcaaggtttctgggctcaccctgccttgccctgtgcagccgaccccagaggagccagctgtgcccatggaagggggctgtggttctggcccatgcccaccctcctgctgatgcctggggtgcaacacaacctcccaaccccaccggcagcccaggctccagg

SEQ ID NO: 81371 - DNA, 583 bp, Homo sapiens
tataataaaaataaggcagaagtcaagaagttacttgtagctagtgagaacaaagatatgacataccagaatccctgggacacagctaaggcagtgttaagagggaaatttatagcactaaatgcccacatcaaaaagttagaaagatctcaatttaacaacctaatatcacaactaaaaggactggagaaccaagagaaaaccaaccccaaaactaacagaagataagaaaaaaaaaaattagagctgaactgaaggagatcaagacacaaaaaaacactcaaaaaatgaggctgggcatagtgactcaatggctgtaatcccagcagttaggaaggtggaggcagacggatcacttgagaccaggtgttcaagaccagcctgaccaacatggcaaaactccatctctactaaaaatataaaattagctgggcggggtggcgcatgcctgttatcccaggtacttcagacgctgaggcacaagaatagattgaacctgggaggcggaggttgcagtgagccgagattgcagcactgcactccaacctgggaaacggagtgagaccctgtctcaaaaaaaaaa

SEQ ID NO: 81372 - DNA, 221 bp, Homo sapiens
aatagtttcattcccttgctctcccaaaataggttccaacgaccctggctctgacttacataatgtacaaaaataagtctgctttaatgttgtatgcagtaggtgttctgtccagggacaaccttgtagtagggacagagtgacctttcaagaaaaaaaaaaaaaggaaatgaaatatactttcattttccagaaatatgcatgcaagtaaaaatttgaca

SEQ ID NO: 81373 - DNA, 494 bp, Homo sapiens
caagcaatcctcccgtctcggcctccaaaagtgttcggattacaggagtgccaccacatgcgttcaccaatatagtatcataaagagtaaaaatcctctcttcggcctagccattcctctaccacccctgtccccaagtgtggcaaccactgatctttttactgactccatagttttgccataacacttgatttggagcaacaaaatgaatatttgcttgtgaaaatattggcattttttgagattgtctcaaaaacagttcctgttctttcttacattgatgaaacaatcatagttttaaagatgataggattgctttccaaaaaaagccccagtgaatttcaggttgaacagtttttttaatttttatttttagagcagttttaggttcacagccaaattgaacagaaagtacagagggttcccatatacctccacacttgtgcagctctaccattatcaacattcgccagcaccagcagggtggtacattt

SEQ ID NO: 81374 - DNA, 495 bp, Homo sapiens
tttttttgtatcaaatttttccagaaatcaacccatcctgtcacttttcatttctttttgctcagaattttaccaagagatttttactatttcaaaacatcatgttactttgattctgccaaaacaacacacctgaatcagtccacactactaagtgcagctctaggcagaagtacacatgttcaagtacttcatacatgtagttgcttccaagcatttgaatactgaaatgcatattatgttattacaaattgttttcctttaatttccctttatattacaactatgaaataatactgtggggtttttcgtttgagacagagtctcactctgtcacccaggctggagtccaaatggtgcaatcttggctcattgcaacctctgcctccccagctcaagccatcctcctacctcaggaggcggagcttgcagtgagccgagactgcaccactgcaatccaccctgggtgacaaagtgagactccatctaatattt

SEQ ID NO: 81375 - DNA, 642 bp, Homo sapiens
agttggtccaaaaggttttctaacctctttaaatttgttaactgcgatagatgaaaaatacatacatccagatgtctggtcaaggaaactgaggaaagctacgaattcctccaatacatatttggttaaaaactccaggggaggtagtaaggagaaagcaataccgtattcctttataaggaagaatagggttaaagcctgtaattgaaggacttattaaagatgggctgctcaaaccttgtatgtcctcatccaatactccaattttaccagtcaagtaatcagacgggtcatactgattagtgcaagaccttagagctatcaatcagatagtctagacgactcatcctgttgtacctaatgctatttctaattggctagaaggatggtccggtcaatagaaagaaactgtagcctcaattcttacttctatagcaactgtaataggcatactccttcttcttgggtgttgtattataccatgcatctgggaattagtaataagattaacaaaaacaactcttactaaaacccatcttaactctcctccaccttattcagaaaaaattctccttttagaaattcaatcagagcaattaagccaagaaatattaaaacagtttgaagaggaaaaactataaa

SEQ ID NO: 81376 - DNA, 308 bp, Homo sapiens
gtctaactagattgtctccctgtaacagacttcttgattcaacaaagcagctctgaatcagcctgaaacctatggcacactgcaaaatggcaaacattcaataggtatttgcccagtaaatgttaatgaaaggaaaaaaattcaaacttcagttggaataggattagagacaagttaaaaaaaagtttcccatagaaatcttcctcatcgtaaatatcatcatcctaaatgtcccgagtctttccatgggtctaatttaccaaatcatgaagactctctttctcactgtgtatgtgtagtgggagagg

SEQ ID NO: 81377 - DNA, 549 bp, Homo sapiens
tctgttaagtgacagggatagattttttcatgatctttgagggctctttcaagctatagcatttttataattttaataactaccacttccacccttgttagattacatttcttgaacaaaataattaccctttcctcccttgcttttacgtcactgccccaaagcagttagttgacttgaaggtgttcttttggagtctcttccagctataaaatctgtgactctaagaaatccacagtttacttaattccttagcaatacaaaagaatagtcattatatcaaatccagcaagtcttcatttaggtgaacctatccacctttcaaaatgtatcaagtctcgcctatgaggaagttgacattttatcaagcatttccaagagaatttcacagctacccctttggagtttatcaatgagcagatgatattagtaacagaatccatttgattctgagagacgaggtctatgaagaaagggaggcagcagtttattaatttccattgttaaaggaggccgggcgcagtggctcgcgcctgtaatcccagcact

SEQ ID NO: 81378 - DNA, 676 bp, Homo sapiens
gtctctactaaaaaactagccacgcatggtggcgggcgcgtagtcccagctactcaggaggccaaagctggaggattccttaaacccagaagcttgagaccagacaaggcaatgtagtgagactccgtctcaaaaaataaataaataaataaataaaaagaaccatgtataaaatatttaaattaataaaggaatctaaaatatatcaaggaacaactcttagacagttatgcaaatttgaaaaagaaccaaagagaaatgttagaaataaaagtataactgttgaaattgaaaacttagtggatgatttgaacaacagataagaccattggcaaagggagaattcatgaactgaaagatctgaagtaatttcccagaatgtaatgttaagaaataagttaaaaggaagagcataatgagtctaacatgtgtgattgaagtcttataaggagagaattaagaacaggcaatattttaaaggaataatggagaaaatggaataattgatgaaatatgtgaatatatatagggaccatatgcatatgaaggaagggggttaaataaaaagaaatctacttgtacatactttatagataactgaagaatatcaaagtcaaagagaagctcttaaaaacagtaggagaggatgggtattctatcctcagtatacagtatt

SEQ ID NO: 81379 - DNA, 603 bp, Homo sapiens
ctttataacaaataatgaaacatttcccaataatgaaaagcccagaaccaagctaagctggtgaattctatcaaatattaaaagaagaatgaacacaagtcattctcacatgcttccaataaatagaacactcagattcattttttgaagccagtattacactgataccaaagccaagggaaagtatcacaagaaaactacagatccaaatcctttatgactagatacaaaaatcctcaacaaaatagtgacaaactgaattcagcaggttattacaaggatttatacatcaagaccaagtgggatttatcccaggaatgcaagattgcttcaacatatgaaaatcaatatgatataccatattagaagaatgaggagacccacataatcagctcagtagatacaaaaaaaagttgcacggaacccaaaatgctttgatgatttaaaaaaaaaaaaaaaagaaaagtgtggaatgggcaaagctttaatttccagtattttttggattcatgaagctgtttaaccagacaaggtgatctgtgtggggatagggctgccgtataccatgtggctgtgggagttttctatatggaagaggggcat

SEQ ID NO: 81380 - DNA, 1147 bp, Homo sapiens
ctttataacaaataatgaaacatttcccaataatgaaaagcccagaaccaagctaagctggtgaattctatcaaatattaaaagaagaatgaacacaagtcattctcacatgcttccaataaatagaacactcagattcattttttgaagccagtattacactgataccaaagccaagggaaagtatcacaagaaaactacagatccaaatcctttatgactagatacaaaaatcctcaacaaaatagtgacaaactgaattcagcaggttattacaaggatttatacatcaagaccaagtgggatttatcccaggaatgcaagattgcttcaacatatgaaaatcaatatgatataccatattagaagaatgaggagacccacataatcagctcagtagatacaaaaaaaagttgcacggaacccaaaatgctttgatgatttaaaaaaaaaaaaagaatacaaaggaactttttttattaataaaaggcatttacaaaaaactcatagctaacgttatacttcatggtaagaatgaaagcctttcctctaagatcaggagagatgtttgaaactcttaatgctttttttcaacattgtactagaggttttagccagagcagttaagtaaggaaaataaataaaaagcatctttactggaaagaaaaaagtaaaactctctcttcataggtggcatgatcttatttctagaaaccctaacaaagccattcaaaggcactattagagataataagcttagcaggatacaagattaatatgtgaaagttgattatattttgatgcaactagcaatgaacaatctgaaaaggaagttgaaacaattccatttacaatagcatcaaaaagaataaaacacttcggaataaatagaaccaaagaagtataagacttgtacgctgaaaactgcaaaacgttgttgaaaggaattaaagaacacctaaataggccgggtgcagtggctcatgcctgtaatcccaaagtgctggcattacgtgtgttagccactgcacacagcctgggagggtttattttgttggttttgttttgtttttttgttttcagggaaaatttgtatttttgatatttggtgcaggagaagtgtgatacttttctgaatgggttagga

SEQ ID NO: 81381 - DNA, 912 bp, Homo sapiens
tcagactgctgtgctagcaatcagcgagactccctgtgagtaggaccctccgagccaggtgcggcttataatctcgtggtgcgccgttttttaagccggtcggaaaagcgcagtattcgagtgggagtgacccgattttccagggatggaagaagatacttggaaaaatcagggaagagtgaagaagatacttcaaaaaatcggggaagattttcatcataaggtccaagcaaagattcctgagcctgagtctactgacaaatataccacatccccagagtaagttggagtctcttaaaattgtcttgctggcatctagcggagattgtccccacaagcatgttccttatgacggatgcctgggtcagaacacataatacattcctttttataagcacaaagattctgagaagcactgcccctcccacgtgtcacactctggggagagattattggaatgcctcttggatcaggtatctttggtgatcattccacctagttaagatgaagctggtgatagcctttggcttgtttcaggtaatgtaaccagattttccagtgacttgtgaattaacaggctaaaaactagttttcagtttctggagaagggttcccaatctcatttgaggctattggaggaaaaatcccttcagaaaataaagcatgacagtaagattttagtatgcaggaagtaaattcagttcctttggagatcagcatgcctctattcaatcctctccttaatcccttatgagtcagatctagtagagggttggaccaggaaattgagtgtagggttataggtgataagatgaggagaggcactcccctcaggagttaagatgcaggaaatttggtttgcactttagccagtacaaggcatttcaccaggatggagaatatgtgctctct

SEQ ID NO: 81382 - DNA, 637 bp, Homo sapiens
atttttttaaagaaacaaaacattaaaaagttttaaactctatagaagtattatgccatagggctttataaagattaagtgaggtaatatataacaagtgcttaaaacatacacagtattacagtagagttagctttattattaatagtaactcaagcctatgatgaccaaaactgagtttttgattcctgcaagttcaacatctgctcctccccttgtctttctgtttaataagttgttacaccatctaccctaattcctgaattccaaaaccttggagtcttctttgatttctttctcatgttctccacgttagtaggccctgctgctttccctcctcagtgtatgctaaactcatttaactttctccatttttactgacaatgcacaccatcatactctgtcatctatgccactgtaacacattcttaaatggtccctctgttcaactgttgcccctgcaattcattctatatgtagtggtgaaagtgaatacatataaacacaaatcaagttttgttacttgatggaaaccctccaataatcattcactatgaataaaatccagaccttttgctatgaccctcaagaccccatgtgacctggtccttgcctacctctctggccttggctctca

SEQ ID NO: 81383 - DNA, 478 bp, Homo sapiens
gaagaaatcaaccagtccagaaacgaaacagcgagtttttggccaacgtcagcaccatcacctcagattattccaccacatcgtctgctgcatacttgactagcctggactccagtcgactgagccctgaggtgcaatccgcggcagagagcaagggggacgaggcagatgacgagagaagcgaactcatcagcaaagggcggcctgtggaaaccgacagcgagagtgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaa

SEQ ID NO: 81384 - DNA, 795 bp, Homo sapiens
ccgaaatcctcactaagctctgcaaagacaacaagctggatggaccctactttcaccctgggaaaatacagataggaaaccaagtcttttctggaaaaactatcttcactgaagaggacactgatgagacagtggagtcttatgaacacctggccctcaaggttttacactcttgggaggatatcccggaagtcgggtgtaggctggttcctgaacacatagaaactcggccactgtaccacaaggataagccacgaatggagcagggccgcctgcagatgtgggtggacatgtttcccaaggatatgcctcaacctggacctcctgttgacatctctccaaggcgacccaaaggatacgaattgagagtgaccatctggaacactgaagatgtcattttagaggatgagaatatcttcacaggccaaaaatcaagtgatatttatgtgaaagggtggttaaagggcttggaggatgacaagcaggagacagatgtgcattacaactccctgactggagagggcaacttcaactggcgcttcctgtttccctttcagtatctcccagctgagaagcaaatggtcattaccaagagggagaacatcttctctttagagaagatggagtgtaagactcctgctgtgttggtgctgcaggtttgggattttgaaaggctgtcctcagatgacttcctgggcaccctggaaatgaacctcaacagtttccctcgagcagctaagtctgccaaagcctgtgatcttgccaagtttgaaaatgcaagtgaggagaccaaga

SEQ ID NO: 81385 - DNA, 460 bp, Homo sapiens
atcagcagatttttctctggtgaatgtctaatcagtgtgatttccataggctatacttaccttttgggggctacttgccaatgatgtttggtcagtatccttgcaaacaacagagtgacagattctaaaaatgactttgcaggccagtactaagaaagacaccaaggttcatgggcttgcaaataaaaagtccataacttccctgccctacttcaccaagtgaaatcgagttcctcacacttctgcacacagctctttcaggatcttcccttcccttcaaggctgtctgatgttcagtttaatttgattgtatttgtataaagtgctgagtgttgagtcctcaaagaaatttactttcagtctaagcccccttggacaagaaagtggcaaccaggcaaatgattgattacttatttgttgagtatcactttgtgattgtcccagggctgtattacacata

SEQ ID NO: 81386 - DNA, 880 bp, Homo sapiens
gcgtgtttacccaatcctgtttctccaatgcaacgtccacccactttaccaccaaaaactccagggcctgacggcagcccggtcccccagcactcaccagcagcccagtgttctccaccaagccacagtgtgcatgcctggtatcctccggattcccttccttctgcccgctgagtcactgggcagagaatgatgacatgtgtaggtggtgtggttgggggtggaaaggggaaggggttgatcctcaggactctgagggagcatcgttgaattttcctgttcagtgtgaccaagacccacctggaaatggaatttggaactggcttcaggagacatcattcctgaacacactgtagggtgaattggtgcatcttccccaccatacacacacacacacacacacacacacacacacacacacacacacacacccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttctacatgctatgaattgagatgacatgctcaacttgtaaataagtctttttgtacattaaaaaagtaattttttcataa

SEQ ID NO: 81387 - DNA, 1849 bp, Homo sapiens
gcgtgtttacccaatcctgtttctccaatgcaacgtccacccactttaccaccaaaaactccagggcctgacggcagcccggtcccccagcactcaccagcagcccagtgttctccaccaagccacagtgtgcatgcctggtatcctccggattcccttccttctgcccgctgagtcactgggcagagaatgatgacatgtgtaggtggtgtggttgggggtggaaaggggaaggggttgatcctcaggactctgagggagcatcgttgaattttcctgttcagtgtgaccaagacccacctggaaatggaatttggaactggcttcaggagacatcattcctgaacacactgtagggtgaattggtgcatcttccccaccatacacacacacacacacacacacacacacacacacacacacacacacacccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttctacatgctatgaattgagatgacatgctcaacttgtaaataagtctttttgtacattaaaaaagtaattttttcataaaaaaaaaaaaaaaaaaaaaaaaaaataaaaaaaaaaaaaaaaaaaaaacaaaaaaaaaaacaaaaaaaaaaagaccacaaatactctaattcattaccctatagatcgaccaaacaaacttaagctcactcaatatttattctaataacaacgctcgctattctacatttactactaactatcaactaataatctcactcatacctctacaatctaatatccatcgccacaatactctaacatacgctatcatcataacaccacatcataatttaatctacaggcgccatcagttggaggaaacaacgcgaccaagccggaacaatctcggccctcatctgcacgggatcataccgcacaaccaccaccaccacgctctgctcaatgcactgaacacacacgacgactaacatatgcagagcatgaggaacagacaagatggctggacgacaaaatgctatgagctgcaacgataagcatcacgatcagggatgcgctacgtacgaccaagagaagagagccacagaagaatagaagggagagactacgacgagcactgaccatcggctgaatagcactcgctacgatgcggagcggggcggaggagggaggcaggagagggctgggcggagtcgcgacggcgtcaccagcgtgcgtctaagctgctggtgattcaagacatatgatagcgctcggaccagcactaacgcaacgtaggcgagcggagcgcaaagatgatcggagtcaaggcagactaaacggaaccaattacgacgagacatcaacacatatccaatgatctaacagacgataagactaggagacggaaagacaagacaaagggagattattgaagagaatgcaagcgacgaagttgctaagcacgtaccaacaaagaaaaagtacggtaagtacagggaatgatcagttatatgacttagaaggtaatggaattacacgagggttgat

SEQ ID NO: 81388 - DNA, 520 bp, Homo sapiens
aacacaaaaaattaaaaaaaaaacaacacacacacacacacacacacacacacacacacacacacacacacccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttctacatgctatgaattgagatgacatgctcaacttgtaaataagtctttttgtacattaaaaaagtaattttttcataa

SEQ ID NO: 81389 - DNA, 177 bp, Homo sapiens
ttaaaaaagtaattttttcataatttatcttgtctatctgcttcccccttgacagtagttaatgagaacctgggcagtaaatttggtgcattcgagcagaaattaggctgtattttttcttaacagtgtcaaaattgactatcccgcctttgccaagaaatgtttaatgctgaggca

SEQ ID NO: 81390 - DNA, 348 bp, Homo sapiens
cctttaaagcagcggatcccctggtccccacccccaactttatattcattaggcctgaggtggggcctgggaatctggatttataaattgctcccctatgattccaatgccagtgggttttagaccacattttgagaaacagtgctgtaaactgttttccatttgcagtgaaggaaaatgtagggtttgtgtcgtgaaactatgcagagaaattgaatagtattttagtctaatcttgcttttaaataacacggaaattttgaaagtcggctttagggagttccagaacctgtccatgaacagcaacaagaaagatccctgtgtgaaaatgaacactggttggtaaaa

SEQ ID NO: 81391 - DNA, 780 bp, Homo sapiens
gccagccacctgaaaggagctgagttctagcctctactgattttgcgtgtgagctccttgccactccaaaatttttcttagccagagggccttgctgtcacttcttttgacttgctcatccatgctccctcagaaggtcctggggctcttcctttgatagccccttggcaagactgcaagctctgagctcctctcagctgcacccaaggtcttaattatcagaaagtttactcttcctgacaaggcttccatcttgccaaatattcagtagggggtggactggcaaactactgtcccaattctcgatacacatcccttagatcagggattccttgttcctttgtcgggtgacagacccattggagaagttgatgaaagccaaacactctttttttcagaagacacagataagagactcctgcttgttatgcagatcaaaacctagcagattacaacatgaaagaaccttgatgacattatgccaagtgaaaggcccaaacccaaaagatcacacgttgtttgactcccatttatatgaaatgtccagagtaggcaaatctgcagagtcagagagcaagttagtggttgccagggtctggggggagggcagaatggggagtgactactggtgaatatggggttcttttttggggtgatgaaaatgttctggaattcgtagtgatagatgcacaactttgtgaacatactaaaaacacttacacgaggatgaacttatggtatgtgagttagatctcaataaagctgttgtttaaaaactga

SEQ ID NO: 81392 - DNA, 915 bp, Homo sapiens
  misc_feature (779)..(779): n is a, c, g, or t
ccgcagccgccgctgtcaggcgcagcaacgggcaaccccgtagaagtcggtcggcaggtcctctccaacccgccgctaccgcgccgctgtgggagagaccccagcaggagcccaagggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagntcctaggccttacccacacttatagcgtgcgcgggtctgagacttcagtggagcgtcggagtgacaggcgccgtggtgacgatggtggttctttcctcgaacctgggaaatccattggttgtccatcatcaagtcc

SEQ ID NO: 81393 - DNA, 709 bp, Homo sapiens
  misc_feature (573)..(573): n is a, c, g, or t
ccgcagccgccgctgtcaggcgcagcaacgggcaaccccgtagaagtcggtcggcaggtcctctccaacccgccgctaccgcgccgctgtgggagagaccccagcaggagcccaagggcagctacgggggcgcgaaggccgctggcgccgcctcggccagcccttcccgcgcgcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagntcctaggccttacccacacttatagcgtgcgcgggtctgagacttcagtggagcgtcggagtgacaggcgccgtggtgacgatggtggttctttcctcgaacctgggaaatccattggttgtccatcatcaagtcc

SEQ ID NO: 81394 - DNA, 663 bp, Homo sapiens
atttgagagaagttgtgatttcgtagataaagggaacatgctgtgaaaagtgtggccatatggcataatgacataaaccctgcagttctaatcaggaggcctgagttctcacacaggttttgccactacctagttgtgtaattgtgaacaactcatttaacctctccaggagattttcctaatatgggcatttctgaggatgcttcaggaccaaattgcatgctacttgaatcataatttaaaatataattttactgctaagccatttttgggtaaaatcataatttcgtctctttgaaataatctgattggaaagatgggcttcttgtgcagatattatgtttttcactcatttctatgaacaaaagattaagttccaaagtgcttatgtttttttgaaggccaggtaatttattgcaaactgtactgggctatacattttgtgtttcagctttcagaagaatctatttacatttaaaataatacccccttttctcccttttatcatgaagttatcttttccattatcttttaaacttaaatacagttaatacttgattatctaaaatggagccttttatgagtcaatcccactttctaattcttaacaaatatggaataaaatagggaattatgccatttttacattacctgtataatcat

SEQ ID NO: 81395 - DNA, 407 bp, Homo sapiens
ggtggtaaaggcagccagaaatgcagagtgtagatgtttattaggcagtgttgaattagtagaacagtaaaccatcagaaacctaattcaggggtagggagaaagttatcttttgccttctttttattcctttaattttttcctgtaaagtgaagagaacataagttttgaagtcagtttatattcgtgacttcattttattttacttacttgctgtgtgatcttgaatgagatttggaattgttatactctcctttacccagttcacaaagatttaaagtagatatgatagttatctcagtttatttttgagaaaatctaatgatataacataggtaacacatttctgttttttactgttcacattggaggagggggtgagtagataagtagcagctattcgtaag

SEQ ID NO: 81396 - DNA, 787 bp, Homo sapiens
gatctacaggatcctatgccccattcctgaggcaaccggcgggagaaaatctacgaagagcagaatcgaggcatctacatgttccgaataaacaatgaacatgtgattgatgctacgttgaccggcggccctgccaggtacattaaccattcctgtgcccctaactgtgtggccgaagtcgtgacatttgacaaagaggacaaaatcatcatcatctccagccggcgaatccccaaaggagaggagctaacctatgactatcagtttgattttgaggacgatcagcacaagatcccctgccactgtggagcctggaattgtcggaaatggatgaactaagaagctttgaggctaccaggcaggggagtccccctacccacaacctcttccctgaaagggatgagggggaagagaggtagcagccagagccaggacccagggttggggctgccggctgacccggagcccctggagcaggaggctggggcagagggccctaggccaagcccaccctgggcaccagggacaatcctcttccccaccaccggccctcaggctggcatctctgcccccagctccaggaggggccagacagaagcagccattgggcatctcaggtttgagggggatatgggccgggaactacccagaagcatctgggaggcagcagggtgggggaagaggatgtgtggccgggcctcacagccctgctgctcccactgacctctccggcccaactcacggctgcaaagagacttgactaagcttgacaatcccaaagggccgg

SEQ ID NO: 81397 - DNA, 608 bp, Homo sapiens
cttgtcccttcttctgcaacctctgcctttctagaatcgaggcatctacatgttccgaataaacaatgaacatgtgattgatgctacgttgaccggcggccctgccaggtgagagatgacgaggaaggagggatttagtggtccctgagagtggcactctgggggatagacgaacaaggaatcaaaattgtcccaagttagttgcctgacatccctgactctgtcccactgcccaggtacattaaccattcctgtgcccctaactgtgtggccgaagtcgtgacatttgacaaagaggacaaaatcatcatcatctccagccggcgaatccccaaaggagaggaggtgagaggaagtatcctgactgagtgacaaagcagctcctcctcctttcaccccttctctgccattccctaaatgtggattcctaggctgggcacctcagatcatatcttctctggcctcccctcttcctgtgggggactagcattgattctgccctcttctcttttcagctaacctatgactatcagtttgattttgaggacgatcagcacaagatcccctgccactgtggagcctggaattgtcggaaatggatgaactaa

SEQ ID NO: 81398 - DNA, 891 bp, Homo sapiens
agagttgctgcatgctagtccttcagctcagaatatttagtgctgtttttcttgcttctgcacaattttttcagttagctgttactattaaataaatggccccaaacacagtagtacaaaactacaaattattgtttctaatgtttctgtgattctgtggaagggctaagaggttgttttgttttgcattgtcttagctgggcctgaatgatctcccactaactcacttacatatctgggtgacacagtttggctctgtgaccccatccaaatctcatttcgaattgtaatctccacatgtcaagggagggaggtgactggatcctgggagtggttttccacatgctgttctcatgatagtgagtgagttttcatgaaatggttttattagcgtctggcacttctcctgtaagcacttttcaaatctctgcttgtggccatttttgttattgccccactggcaaaagcaagtcatatgccaatccagacttggaagatgcggaaatcaaccccactcatcaataggggaagtagtggcaaagtcacagcacaaaaagatgtatacaaacggattagaggcgtcattgcagctttttttgaaaatgatcttccacatcaatcttttagcctcccttcaagtttctcttctttaagatgaagtttaggaagaacctactcatcccatccataagttttgtgtgacttcctactctcagagaatcttttattgttttcctttctggcattaattatatttatcagcaaatattttagaacttgtgtatgtattaatgcttatccagtataatcaagtcaactcagtgtctactgagctggcaatgctcaatatttttttaaatgaatgaatgattgaattctaccaatgggtga

SEQ ID NO: 81399 - DNA, 255 bp, Homo sapiens
gaaactgaggtgcagcttttcctctgagccccggggaatagcatctttgctcgagtcagctgctgggttcgtccatggtcctggctggccttcctcaccagcggggaacctaagtgcagacctcagggtggcctcactcccttgtaagtggcaggttcctggtgggtgggcaggtgggtggccagtggccctgtgccactgccacccgtgtctctggggcttgaagtacatggcggagcgtgcctgtcctgcctc

SEQ ID NO: 81400 - DNA, 936 bp, Homo sapiens
gggatcttggactccctggaccctccctccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaaccctgaactaaacatcacacactgagaatctcttcataatctagggcacagataatctttaacactaaactactgtgaaattctaccagcattaagtactgtatatcgccctgtacttggataggctggctactcgtaggagagagcacgttggtatccttttgctttattcaccagcatttgggggaacattccttttatgttttaaataaaacttcagcatgaagaaaaaaagtaaaaacaataagttagtaaatattcat

SEQ ID NO: 81401 - DNA, 642 bp, Homo sapiens
gggatcttggactccctggaccctccctccagcccagcctcgctagctccgcctgcggtacgtgtctggggaggtggaaacaagtgtggggcctgtgggaggaccgtgtaccacgcagaagaggtgcagtgtgatggcaggagcttccaccgctcccgcctccgactcaatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggataaaattcatttcagttactgctgtccatatgaatattccacactggttcttgtttaatgaaatgtcactggcatta

SEQ ID NO: 81402 - DNA, 911 bp, Homo sapiens
gggatcttggactccctggaccctccctccagcccagcctcgctagctccgcctgcggtacgtgtctggggaggtggaaacaagtgtggggcctgtgggaggaccgtgtaccacgcagaagaggtgcagtgtgatggcaggagcttccaccgctcccgcctccgactcaatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaaccctgaactaaacatcacacactgagaatctcttcataatctagggcacagataatctttaacactaaactactgtgaaattctaccagcattaagtactgtatatcgccctgtacttggataggctggctactcgtaggagagagcacgttggtatccttttgctttattcaccagcatttgggggaacattccttttatgttttaaataaaacttcagcatgaagaaaaaaagtaaaaacaataagttagtaaatattcat

SEQ ID NO: 81403 - DNA, 334 bp, Homo sapiens
  misc_feature (322)..(322): n is a, c, g, or t
ctcatgttcaatctagtgtgatcagtgaccagttgagggggaaaacgattctctctgagctttgcttggcttttccttttgccaccaagccactgaaaagtataggaagaggcaaggcattgcaacatgggatagctgcctcctatacgagactgttaatactgtgtatcagtaagtgaggtggaagagggagttaggttatcagtttgtttctcaccattttggccagactggtctcgaactcctgaccttaggtgatccgcctgcctccacctcccaaagtgctgggattacagggcatgagccaccattcctggcctanccctggcatttt

SEQ ID NO: 81404 - DNA, 382 bp, Homo sapiens
ggtggaggaggctaaaataaatatggagtagcatatttacctttcaaggagtgtatcatccaataagtgaattatgctttaaaatataagtagaatattaatgagctgtaataaaggaacatttttcctgggaggaagaacattaacaaagtaaagagatcttaatatgaatgctatgtaagatgttatatgagtgtcatgtatgagatatttttgatctatttagataaaccataagactcttgttagagcatagtagaaaaaatgatatgactcagctttctaaagccttgaatattgggcagaagaggttagagtttataaaaaagaaatattggtttcttgcagattcttgatcaatgaataaaaagtattaaagttt

SEQ ID NO: 81405 - DNA, 376 bp, Homo sapiens
caggaaaacagaaatgcctgtcctcacctagatccgtgggcacagaaccggggatggagccctcgcgagggaccatgcccttcccttcccagcgcttgcctgcacacttctgtatcagtagggtcttactctttctcaggggattggagccctagccagggaccatgcccttttcttcccagcacttccttgcctccctccatatcaatagagtctcattttgttgctcaggctggagtgcagtggtgtgatcttggctcactgcaacctccacttcccgggctcaagcaatccttccgcctcagtgtcccaagtagctgggaccacaggtacgagccaccatgcctggctgatttttttatttttagtagggacg

SEQ ID NO: 81406 - DNA, 393 bp, Homo sapiens
cattatcttaccttgaatttttatttttgtaactaataatttgagagttcaataagtatgcagtgtttaagacatagtttgttgcaaaaagtgttaacttactatttctttttacaataaaattagcctttattctagttgatttcataactgtccataatatttagctgtggctattatgaaagtatatttgatagccaaattttgaaagctattatgaaatgatacaattcactacatgatttattatttcatgctggttggggcagtgctgtgacttatgaccttatgattgtcacatgctgaacactaaagctctaccagtttgttatggacactgttttactttatgttatcgttttaatgttttcttttataattattgaggataag

SEQ ID NO: 81407 - DNA, 669 bp, Homo sapiens
ccctttagtaaaatagaaataatgtcagtcttgaaagaatgtcatgaggctttcatgaggacacatggaaatggcagacatttgtcttgctggaaggttctcccgtttccccgcccctattccaggtaggttgctgtcctcagtacctgaggttttatgtggaatcaccattctccttcccatgattgtaagtcagattataagcagcatttgagtagatggaaatgtgattaggtctatgtccctcatcccaacattctttatgccagctttcattcccacagctccagctggagacatgcacccacaacttagctgtgccttggggtgtcctgtctactgcaggacgtctttcagtgcccataacgttcttctccaaattaggtttctgagcctttgcatattacatcacagggctgggcccatgggactgcaatccgggaggatggtcctaggcacaaaattgaatcttgagataggtctaaggtttgccatcaggattaatgaaaataagtgtacaccggggcatgcttcactaactggaagtcactattattaaactgagaaccggaagggctagatctggtcataattctgttaaccaactgcataacctttaagccggaacctttacctgtaaaataaaggagtagatgatttctccagttc

SEQ ID NO: 81408 - DNA, 190 bp, Homo sapiens
gtgcagattctgggaaagtgaactccacggaagactcagaaaccaagttctaattcagttgccatgaaaacttaaggtgagaggattgtcaaccagtgaaaaatacggaggaaaacactaacagaatatgatgaagaagccaagacttgggctgcttgcattacattaaccgaggtttacccgcagcgag

SEQ ID NO: 81409 - DNA, 269 bp, Homo sapiens
cccatttgtttgttctaataaaaatgtaggactgaatttgactcacagttgactaatttacattctaaagtggccagaaaacttctattggtagtttccttcataggaaaattgggaggttctcactcaaaattggcttatatttgggcatatgttaggatacatgtaatgtttaagtaaaagtaatactttgaatatcaagctaactagtgataagtttatggttatttatactgttaggtaatagggtattttaatctaccccttat

SEQ ID NO: 81410 - DNA, 783 bp, Homo sapiens
agctcagtgtccacatctgtaaattggaaatgataacacccacctgaacacccacctgcaaggctgagaagagaattgaataagacttctcctgtaggaagcccagcccatcttaagctctttggaaaggttttaatgtgtaagaagattttttgcaattggttctcccatatgtgaaatggggttaaccctgttccttgccttaccaacctctccaggctgctgtgaggattaaatgaaataacacattctgagaactttgatgggtcataagtggggtgcctgtgttagttctggctactggaggcacagggtcccttccagcctcatctctacaggtacagagtcatggttgggcccaagctgccaaggcctgtgcacagttgctctgtttgcctacagtagccttcatgcctcctgattcagcatcagaagtgcccttgggaccctttcctaggtcagcactgcatgctgtgtagcaacatccagttctgctagtttggattacctggccccaccatacccccaacacattaccccgtggctaaagtgtagatgttagcggcaagttctagagcccagtttaagcagctgccccttcctcctgtcaagtgtgtgaccctgggcaacctgaagagcctctgcctgctcctctgaatatgggatgatgtatggtaaacgtacccaccccttaggcttgtcaagagcatggaatgagatgatgcttacaaagctcctagcatgtggtgagtgctaataaatagtagctgtttttacacagga

SEQ ID NO: 81411 - DNA, 504 bp, Homo sapiens
caagtaccaacagatgccaccaagtaccaacagatgccaccaagtatccttactgtcgttctgaaactgagtctgtgactgcagataatatgtcactatttgagaataagaggtcccaccctctccattcttttcaggtcttcagtcacaaggtcacaccttactttcattgtttaacaggataaattaatcaggttgaagtaggacttaggaggtacattgaagataaaagcaaaacgcagcaaacatttttacaagtagatcatcgcggttaccttaaaagttaagtttcagattaatttacagagtagtgacagaatcataatttcagtgaaaatcaacaatagagttgtatcattgaaaaaagataaatttggaaatactaagtcaggcaagcacgcgaaattcagaatattaaaaaaggcaaggcctggttgccaacatacgttcctcagatgaaggtggatatgaagatactaaacagaaccaaatgaccgagaagct

SEQ ID NO: 81412 - DNA, 387 bp, Homo sapiens
ctggtttgggccagtctggatctcaaactcccggtctcaggtgatcggcccacctcagcctcccgaagggcggggattacaggcatgaaccaccgcgccggaccatctttccgggattataatagattctggatgggcctccttcccgttttccacggttggatatatatattatggccccacatgctctgactctctcaccaggaacaccggaaccactcacatgggttcccagccacttaggacttctccagcgtggctgagtctggttctggggattcccaagggggcctgaggaaggctctttggactctcaccccaccccaggtccctcagaacagccccatttccccttttttctctgtacagaattcccacatgttattc

SEQ ID NO: 81413 - DNA, 299 bp, Homo sapiens
gcttgatcaatcaacattttaatgcatctagtgtattaaatttgtgtatttaattcacaacaatggtaatctttccagggcagtttctttctagggatcctttgaagttagcagcaagatgaaatattagataattaatcaatatccaattacttaatgtacgtaaatatgacagacttcttatctttgcccagagtactaggatttaaattctgataaatatctattttgtgccatcactagtatttttgttgtctttcatcttttccactcttattctatttctttacatggtgcgg

SEQ ID NO: 81414 - DNA, 484 bp, Homo sapiens
cccccctgtggattggcatcgtacgtcttagaggtggagatgagggatcaagaaagaccagcagtgagggtccttagagacctgaaggctgacacagcaggtagagacgagggcagggggcaggagccgtgctcagatttgacttggtggcaatattccgagggggcagaaactcacattcctgggacagggccctgtacggcctgtggtgggttccgtcctggtcccaggagagatcccggatgagccaggccaggcccatgcaggaggtgcatggagctgagatccagggttgacaccagctggccgcacgcgttgggcccttctccgccaggccacaggcagcctgtccacctgccgccccaaagccagtgctgggccccagcagaactgcaaggcccacccattctccgtcggcacctgcacggcctctccctctcctgccctgggggtgggtcctgaaggtgcctcacacacctccagt

SEQ ID NO: 81415 - DNA, 178 bp, Homo sapiens
tttgttgtctttatgatcttgatgcttttttgaagagtactggtcgttactttgtagaatgtctttcaatttgggtttctctgatgctttcttatgattaatgtgggattatacatttttggcaatataccgaagtaatggtatcatatcaggaggtatgtttatatcaggggctaca

SEQ ID NO: 81416 - DNA, 3262 bp, Homo sapiens
  misc_feature (1516)..(1516): n is a, c, g, or t
  misc_feature (1605)..(1605): n is a, c, g, or t
  misc_feature (1733)..(1733): n is a, c, g, or t
  misc_feature (2516)..(2516): n is a, c, g, or t
  misc_feature (2531)..(2531): n is a, c, g, or t
atattttcagcatcacattttaagaataatatgtgaaatacaatatgttttattagtcacctttggaaaatacagtcttccacaatctggaaccacctctttggttcaaaatgtgccattcttctgtaatgtgtgtgataaacttaaaaaaaatctgtatcctttatcctaatcatcttacttggacatcatcctgaaacaaatgacaaaaacattcacagttttatatacaaagttattggtaacaatgttcttaatagaattcaattagaaaacatataaaggcaaaggtagagttatttgatgttatggtttgaaaggattcccacaccctcatgaatattctttattatgccagagggaacctaattcccctgcctttgagtgtgggatggcattgatgagttacttgtaccacatataataggcaggaagtgatggcacgtgacattggaaacaacttcgtaaaagtcaccgagactcattccttgctttctcctatgtctcccacctggcaggaagacatttgccatcatgtaaggagagttctgcttagtgaggcattgacatctccagccagcagtgccgtgagggaggtgggcagctcaagcctcagtcaaaccctgagatgaccatggtcccactcaacatctcagctgtgaccatgtgggagaatccaagcctgagccaatcagcctagctgctcccagagtcctgactctcagaaaccatgccagattatacatatctgcagctttaagcttctgagattttggaatgactgatgacagagcaataaataactaatacatttcaccacatatcacttagcagaatgccatggagctattaaacacaatattttatgaagattagtctatgatatggagatatactcacaatgttattagcaacacaactagaccaactgagtataggtagtataatctcaatttgttctaaaaatataaatctgtacaaagatagaaagaccagaagaaaaaaaccatttaatacttgatagataattacaatggtaaagaatttagccttgatcacttgatttgagatggaatctaacttgctagctgtatacccatagttgtggatgtgtaaccaatgatttgtaaactaattctcagtttactcgtctatataaaagagctagtaatattacctatttcatgcggcttgggagaaatgaatcaataatatatagaagggcttagttctcatattgtggcaagtacttcacaaatgataatttttactattacaatttttataaggctttctgtaattcacaaattttctaatatctattttatgacttttgaaataattcttacaatatcccttttagtaacctttattacaaaatctattgtaatctcttaaaataatattcctttttgtttttctccgagatagtctatctaatgatgttacaatagagttaccaacaaatgccatatttcattcctgagcgtctatattcttgagttcctagcaacanagaacaaagtagcaaccatttcttaagaaaatgctgagatggacaccagagtttcaagcaattttcatccagaaggtcacatgttaggngtaaaagctatatggaatcttgaacaagcatagcatctaatagccttatttgattaaaaaaatgaatacacacaaaaattttttgaagactaactaccccttagaaatgttcgttaacttggtcagtnatataagcctacctcccatttattcaatagatcaggtaactcccctctttgttatgagcctagttttctagaggtggaccagattccatcatatgtacatcactcagctagttgagctctctaaatgaaaacttcagccgtagccactggatagaagaatacaagaaggaatgccgacttgaggagcaagttgtgttgagttcaggcattgctttggagaatctgcttcttcacctgctggcttaaagggttggatgacctgaggcagcagcagaagtttagacaattatggttggatgattcttaactgtcctaatcccaagtcctcaatttataagtgaggaactggaaaatcattcacacagctagctgcaagcaatgacagccttggagagaaatcaacctgtgtacagctcagtcccatctgagttctttggagaacaaactccagcagctacttctagaaaatatagacagcatattcagccaatctcctgagctggtgggacatttttacatgaacaaggcctccctccacatgaattgcaaagattcagtggactttgcatgattattcttctaatcttacattaagctttattttggattttaaaaaaatctgccacgtgtaagggcaccaatgtccaccaatattgttatataaaataacattattaatccttcctgtttatcttttaatcagaactaagagggatggtggatgatgaatgcatgagtcatacttacttcatgattctataaatcctaattttcacttttttnaaataaaaattgcangcaaaccaaaaagaagctgcctaaaacagacgtggagatactctacttaggtttcccagggaaagacaattttaaaaaacaattttagcaacaaaaatacatgggcagggaatacacgcatttattatcatttttcctcttaaagcagctatgatgagacacgtccaaaacacctgctcttgtgtactgcccagtttcacgtgagttctgtgggataacactgaatccactcttcaactacagtgaggaagtgatagaactgcttctggcacaccaaagaacagcacagaggtccaaatacatcttccttaggtgcccatgaatttaaatttatttctgctttatcctttaaaaaaaaatctaacgatttcaaatgccttgctgaaatcaacaccctctgcaacagccctctcaggatagttcatcctagtaggtctgtcaaaactgaaacaccaacatgtgagttcctcctctgggttttaaatgttagtactgtgactacttctttgtttgttttcacttttaattgacaaataataactgtatatgttatacagtaaatctgacattttgatataaaatgataactagtgactatttattgctgtgatgttgtccccgcttgtttattggctctgatggaacttttcaggggaatggttataactgaaaaatctgtaatgctaggaatttaacttttctacataaaatgcattttttcttactgatat

SEQ ID NO: 81417 - DNA, 723 bp, Homo sapiens
tttttttagcgaatgaaatattgaagtataagattccttttatttttcaaaccaatggggctgtgtctattgtccccctcggtccccaggggtggggggccttggaaggcagggcggtgttggggggctggggggcaggctgaatgtgtgtgtgtgggtgtgtatgtgtggagtgtgagtgtgtgtttccatggtaggactccagtcccagctgctgcctaggctcctgtgggtcctgtgggtccccctcccctgttcaccttccccaacagggctatagtttaagggtgtcccaggccttggctggttggctgggcccagctcctgggggctgggcagggcagggcagggccgggtccacttccattgttagcagttgtttgcagaattttctcttttaccattcctctctttttgttctcgcccagagtgggtggttttttgttgttgttttagattttcatgtgaaggcagttttttttcttttttaactccccatccccctatgcagggtgtcatttcaccatccacatccacatccttgtttgtgtttctggccctcgtcctccctgcctctcatctgcctccccaacccccacctgggcccccaagtgagattgcacatttaactactgtaaggagaggagcggcgttggcaaatgtgaaccatgagaatatcagtgatactgatgagaataaactaaacgcctttgtaacagcaaa

SEQ ID NO: 81418 - DNA, 1805 bp, Homo sapiens
tttttttagcgaatgaaatattgaagtataagattccttttatttttcaaaccaatggggctgtgtctattgtccccctcggtccccaggggtggggggccttggaaggcagggcggtgttggggggctggggggcaggctgaatgtgtgtgtgtgggtgtgtatgtgtggagtgtgagtgtgtgtttccatggtaggactccagtcccagctgctgcctaggctcctgtgggtcctgtgggtccccctcccctgttcaccttccccaacagggctatagtttaagggtgtcccaggccttggctggttggctgggcccagctcctgggggctgggcagggcagggcagggccgggtccacttccattgttagcagttgtttgcagaattttctcttttaccattcctctctttttgttctcgcccagagtgggtggttttttgttgttgttttagattttcatgtgaaggcagttttttttcttttttaactccccatccccctatgcagggtgtcatttcaccatccacatccacatccttgtttgtgtttctggccctcgtcctccctgcctctcatctgcctccccaacccccacctacccactgctcccaggggtctctccaggggcagggggattttaggagatggggtgggggccagcccctactggacccttgtaatctgatttggagaccatccccccgatgggaccagcagccccgccggcccactgggggtccctcttaacatctgcttgttgcgggggtcagtcatgagtgccagggtctggctggggtcttggcactgtcttcctggccggggcctgaaaccttagcccccagccggcctgagtgggggatattgacacccccagctaaagcacaagcaccttagtcacccctcctctccccccgcctcctggcctgccaccccaccccagcgtttaccccaaagcacaatgccctggtcacttggcaagcggctgggcctgacggaggccgaggggcagaccggggctccagccagacccctgaaaggaagcaggtgctcccccacttccaggccttagttggggtgggggggccagctcctgggcctggggtcttctcacccccacccccttgtcctgggtaggcccctgcctgcccctctctgccttttcctcgggtgtccctcctcgagcccctgtggcattggcttgggtggcagagcccacttgtttcagggaccccaggaggtgccccctggctcccaggactgtgtgtgggtccggggggtgggggggtggggagaagggtcgggcagggggtgcaggggaggaaactcctcaccaggagagccaaagacagggttgtgccttaccccaggagccacccctgtaccccccttgccctgccattcaccctccacccctacccctgggcggcctgctgctttttccttctcttcctcccctgccctgagctgcatggttcccccaccctgggcagccaggaaggaatctgaatggagaatcaccaaccaccagagaaaaaagactgtggggccctcccctgccaactccccttccctggccgcccactcaacccacacctctttcacgcaggacaggctgcccaccctgtccacgtgaagtgccaacgccctccccaccctgggccgagcccccacccctccctgggcccccaagtgagattgcacatttaactactgtaaggagaggagcggcgttggcaaatgtgaaccatgagaatatcagtgatactgatgagaataaactaaacgcctttgtaacagcaaa

SEQ ID NO: 81419 - DNA, 1583 bp, Homo sapiens
tttttttagcgaatgaaatattgaagtataagattccttttatttttcaaaccaatggggctgtgtctattgtccccctcggtccccaggggtggggggccttggaaggcagggcggtgttggggggctggggggcaggctgaatgtgtgtgtgtgggtgtgtatgtgtggagtgtgagtgtgtgtttccatggtaggactccagtcccagctgctgcctaggctcctgtgggtcctgtgggtccccctcccctgttcaccttccccaacagggctatagtttaagggtgtcccaggccttggctggttggctgggcccagctcctgggggctgggcagggcagggcagggccgggtccacttccattgttagcagttgtttgcagaattttctcttttaccattcctctctttttgttctcgcccagagtgggtggttttttgttgttgttttagattttcatgtgaaggcagttttttttcttttttaactccccatccccctatgcagggtgtcatttcaccatccacatccacatccttgtttgtgtttctggccctcgtcctccctgcctctcatctgcctccccaacccccacctacccactgctcccaggggtctctccaggggcagggggattttaggagatggggtgggggccagcccctactggacccttgtaatctgatttggagaccatccccccgatgggaccagcagccccgccggcccactgggggtccctcttaacatctgcttgttgcgggggtcagtcatgagtgccagggtctggctggggtcttggcactgtcttcctggccggggcctgaaaccttagcccccagccggcctgagtgggggatattgacacccccagctaaagcacaagcaccttagtcacccctcctctccccccgccctgcctgcccctctctgccttttcctcgggtgtccctcctcgagcccctgtggcattggcttgggtggcagagcccacttgtttcagggaccccaggaggtgccccctggctcccaggactgtgtgtgggtccggggggtgggggggtggggagaagggtcgggcagggggtgcaggggaggaaactcctcaccaggagagccaaagacagggttgtgccttaccccaggagccacccctgtaccccccttgccctgccattcaccctccacccctacccctgggcggcctgctgctttttccttctcttcctcccctgccctgagctgcatggttcccccaccctgggcagccaggaaggaatctgaatggagaatcaccaaccaccagagaaaaaagactgtggggccctcccctgccaactccccttccctggccgcccactcaacccacacctctttcacgcaggacaggctgcccaccctgtccacgtgaagtgccaacgccctccccaccctgggccgagcccccacccctccctgggcccccaagtgagattgcacatttaactactgtaaggagaggagcggcgttggcaaatgtgaaccatgagaatatcagtgatactgatgagaataaactaaacgcctttgtaacagcaaa

SEQ ID NO: 81420 - DNA, 1611 bp, Homo sapiens
tttttttagcgaatgaaatattgaagtataagattccttttatttttcaaaccaatggggctgtgtctattgtccccctcggtccccaggggtggggggccttggaaggcagggcggtgttggggggctggggggcaggctgaatgtgtgtgtgtgggtgtgtatgtgtggagtgtgagtgtgtgtttccatggtaggactccagtcccagctgctgcctaggctcctgtgggtcctgtgggtccccctcccctgttcaccttccccaacagggctatagtttaagggtgtcccaggccttggctggttggctgggcccagctcctgggggctgggcagggcagggcagggccgggtccacttccattgttagcagttgtttgcagaattttctcttttaccattcctctctttttgttctcgcccagagtgggtggttttttgttgttgttttagattttcatgtgaaggcagttttttttcttttttaactccccatccccctatgcagggtgtcatttcaccatccacatccacatccttgtttgtgtttctggccctcgtcctccctgcctctcatctgcctccccaacccccacctacccactgctcccaggggtctctccaggggcagggggattttaggagatggggtgggggccagcccctactggacccttgtaatctgatttggagaccatccccccgatgggaccagcagccccgccggcccactgggggtccctcttaacatctgcttgttgcgggggtcagtcatgagtgccagggtctggctggggtcttggcactgtcttcctgaccggggctccagccagacccctgaaaggaagcaggtgctcccccacttccaggccttagttggggtgggggggccagctcctgggcctggggtcttctcacccccacccccttgtcctgggtaggcccctgcctgcccctctctgccttttcctcgggtgtccctcctcgagcccctgtggcattggcttgggtggcagagcccacttgtttcagggaccccaggaggtgccccctggctcccaggactgtgtgtgggtccggggggtgggggggtggggagaagggtcgggcagggggtgcaggggaggaaactcctcaccaggagagccaaagacagggttgtgccttaccccaggagccacccctgtaccccccttgccctgccattcaccctccacccctacccctgggcggcctgctgctttttccttctcttcctcccctgccctgagctgcatggttcccccaccctgggcagccaggaaggaatctgaatggagaatcaccaaccaccagagaaaaaagactgtggggccctcccctgccaactccccttccctggccgcccactcaacccacacctctttcacgcaggacaggctgcccaccctgtccacgtgaagtgccaacgccctccccaccctgggccgagcccccacccctccctgggcccccaagtgagattgcacatttaactactgtaaggagaggagcggcgttggcaaatgtgaaccatgagaatatcagtgatactgatgagaataaactaaacgcctttgtaacagcaaa

SEQ ID NO: 81421 - DNA, 1741 bp, Homo sapiens
tttttttagcgaatgaaatattgaagtataagattccttttatttttcaaaccaatggggctgtgtctattgtccccctcggtccccaggggtggggggccttggaaggcagggcggtgttggggggctggggggcaggctgaatgtgtgtgtgtgggtgtgtatgtgtggagtgtgagtgtgtgtttccatggtaggactccagtcccagctgctgcctaggctcctgtgggtcctgtgggtccccctcccctgttcaccttccccaacagggctatagtttaagggtgtcccaggccttggctggttggctgggcccagctcctgggggctgggcagggcagggcagggccgggtccacttccattgttagcagttgtttgcagaattttctcttttaccattcctctctttttgttctcgcccagagtgggtggttttttgttgttgttttagattttcatgtgaaggcagttttttttcttttttaactccccatccccctatgcagggtgtcatttcaccatccacatccacatccttgtttgtgtttctggccctcgtcctccctgcctctcatctgcctccccaacccccacctacccactgctcccaggggtctctccaggggcagggggattttaggagatggggtgggggccagcccctactggacccttgtaatctgatttggagaccatccccccgatgggaccagcagccccgccggcccactgggggtccctcttaacatctgcttgttgcgggggtcagtcatgagtgccagggtctggctggggtcttggcactgtcttcctggccggggcctgaaaccttagcccccagccggcctgagtgggggatattgacacccccagctaaagcacaagcaccttagtcacccctcctctccccccgcctcctggcctgccaccccaccccagcgtttaccccaaagcacaatgccctggtcacttggcaagcggctgggcctgacggaggccgaggggcagaccggggctccagccagacccctgaaaggaagcaggtgctcccccacttccaggccttagttggggtgggggggccagctcctgggcctggggtcttctcacccccacccccttgtcctgggtaggcccctgcctgcccctctctgccttttcctcgggtgtccctcctcgagcccctgtggcattggcttgggtggcagagcccacttgtttcagggaccccaggaggtgccccctggctcccaggactgtgtgtgggtccggggggtgggggggtggggagaagggtcgggcagggggtgcaggggaggaaactcctcaccaggagagccaaagacagggttgtgccttaccccaggagccacccctgtaccccccttgccctgccattcaccctccacccctacccctgggcggcctgctgctttttccttctcttcctcccctgccctgagctgcatggttcccccaccctgggcagccaggaaggaatctgaatggagaatcactcaacccacacctctttcacgcaggacaggctgcccaccctgtccacgtgaagtgccaacgccctccccaccctgggccgagcccccacccctccctgggcccccaagtgagattgcacatttaactactgtaaggagaggagcggcgttggcaaatgtgaaccatgagaatatcagtgatactgatgagaataaactaaacgcctttgtaacagcaaa

SEQ ID NO: 81422 - DNA, 1044 bp, Homo sapiens
tttttttagcgaatgaaatattgaagtataagattccttttatttttcaaaccaatggggctgtgtctattgtccccctcggtccccaggggtggggggccttggaaggcagggcggtgttggggggctggggggcaggctgaatgtgtgtgtgtgggtgtgtatgtgtggagtgtgagtgtgtgtttccatggtaggactccagtcccagctgctgcctaggctcctgtgggtcctgtgggtccccctcccctgttcaccttccccaacagggctatagtttaagggtgtcccaggccttggctggttggctgggcccagctcctgggggctgggcagggcagggcagggccgggtccacttccattgttagcagttgtttgcagaattttctcttttaccattcctctctttttgttctcgcccagagtgggtggttttttgttgttgttttagattttcatgtgaaggcagttttttttcttttttaactccccatccccctatgcagggtgtcatttcaccatccacatccacatccttgtttgtgtttctggccctcgtcctccctgcctctcatctgcctccccaacccccacctacccactgctcccaggggtctctccaggggcagggggattttaggagatggggtgggggccagcccctactggacccttgtaatctgatttggagaccatccccccgatgggaccagcagccccgccggcccactgggggtccctcttaacatctgcttgttgcgggggtcagtcatgagtgccagggtctggctggggtcttggcactgtcttcctggccggggcctgaaaccttagcccccagccggcctgagtgggggatattgacacccccagctaaagcacaagcaccttagtcacccctcctctccccccgccctgggcccccaagtgagattgcacatttaactactgtaaggagaggagcggcgttggcaaatgtgaaccatgagaatatcagtgatactgatgagaataaactaaacgcctttgtaacagcaaa

SEQ ID NO: 81423 - DNA, 5218 bp, Homo sapiens
aggcattgaacaaacatttattttttgccttccacatgccaggacctactgcgtctcctccggatgggtgctcctcgccgacaaagtctagattgtgattatctcaaggacttgagttaccctcacttccgacctcctctctcacaaactggttccaggcggggagactgaggatgggctggggaggctggcagaggcgatccccacctcgcggagcacaacatctgctgtgttctgcggcgagcgcctgtcaagcagtgggaggaaaaagcgcttggagccaccagcccactcttaagcgaaactcgcctggaaaacaccccgcctcccagcagagtttctgccggtttctttagaagggtggtgcggaaaagcaacttttgggaacttgaaggagtggggtgtggggcgaagtggaaagagcacacaacgcgaccccactcagtccccgcttgggactcccatcccggcatcaggcgtagtgggcggtccgggccagggccagggccagagcggcggcggcgaggccatgccgagggcccgtcggccgcagttccccgtccggcctcgcgggggcgccggcgctgccgatcaggtgaccgagggcccgttcggggctgcgggaagcggcctcgttctcagccgccggagacgccgccgccgccgccgccgccgccacacctagtggagcagccggggaaggcggctcgttgggggctggggcggagagcgccgggggtgggggcggaagggcggcgggcggaaggcaggaggctgccggggcgcgggctgctgcgggagaaggggctccgaggagtccgccgcggctcgctctgtcgccggcgcgggattggggcgcgagggccatgggcgcgctctcctaaggcggaggtcgcgggcgggaggggaggaggcccgagagaggctgctgcgaaggccgcgggcccgtgactgggcgcgaggcggccggcggcggcggcggcaccagcaccaccatgtcgcgctcagtgctgcagcccagtcagcagaagctggcggagaagctcaccatcctcaacgaccggggcgtcggcatgctcacccgcctctacaacatcaagaagcaaggacaagtttggaaggcatgtggagaccccaaggcaaaaccatcctatcttatcgacaaaaacctggaatctgctgtgaaattcatagtcagaaaattccctgctgtagaaacccgcaacaacaatcaacagcttgcacaactacagaaagaaaaatcagagattctgaaaaatctggcattatattacttcacatttgtagatgttatggaatttaaggaccatgtttgtgaattgctgaatactattgacgtttgccaagtcttctttgatattactgtaaactttgatttaacaaagaactacttagatttaattataacctatacaacactaatgatactgctgtctcgaattgaagaaaggaaggcaatcattggattatacaactatgcccatgaaatgactcatggagcaagtgacagagaatacccacgccttggccagatgattgtggattatgaaaaccctttaaagaagatgatggaagaatttgtaccccatagcaagtctctttcagatgcactaatttctcttcaaatggtatatcctcgaaggaatctttcagctgaccagtggagaaatgcccagttattgagcctcatcagtgcacctagtacaatgcttaatccagcacagtccgacactatgccttgtgaatacctctctttggatgcaatggaaaagtggattatctttggctttattttgtgccatgggatcctaaatactgacgctacagcactgaacctttggaaactagctcttcaaagtagctcttgcctctctctctttcgggatgaagttttccacattcacaaagctgcagaagacttatttgtaaacatacgaggctataataaacgtattaatgacataagagaatgcaaggaggcagccgtgtcacatgctggttcaatgcacagagaaagacgcaagtttttaagatctgcactgaaggaattggctactgtcctctctgatcaacctggattgctaggtcccaaggcactttttgtttttatggcattatcctttgcccgtgatgaaatcatctggctacttcgtcatgcagataacatgccaaagaagagtgcagacgactttatagataagcacattgctgaattaatattttacatggaagaacttagagcacatgtgaggaaatacggacctgtaatgcagaggtattacgtgcagtacctttctggctttgatgctgttgtcctcaatgaactcgtgcagaatctttctgtttgccctgaagatgaatcaatcatcatgtcctcttttgttaacactatgacttccctaagtgtaaaacaagttgaagatggggaagtatttgatttcagaggaatgagattagattggtttaggttacaggcatatactagtgtctcaaaggcttcacttggccttgcagatcacagagaacttggaaagatgatgaatacaataatttttcatacaaaaatggtagattccttggtggaaatgttggtggaaacatcagatctctccatattttgtttttatagtcgtgcttttgagaagatgtttcaacagtgtttggagttaccctctcaatcaagatactcaattgcatttccactactttgcactcattttatgagttgcacgcatgaactatgtccagaagagcgacatcatattggagatcgcagtctttccttatgtaatatgttcctagatgaaatggccaaacaagctcgaaatctcatcactgatatttgcacagaacagtgtacccttagtgaccagttgctacccaagcattgtgccaaaactatcagtcaagcagtgaataagaaatcaaaaaagcagactggtaagaaaggggaacctgaaagggagaaaccaggtgttgagagcatgaggaaaaacaggctggttgtgaccaaccttgataaattgcacactgcactttctgagttatgcttctctataaattatgtaccaaacatggtggtatgggaacatacctttaccccacgagaatatttgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtgttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcacactt

SEQ ID NO: 81424 - DNA, 4304 bp, Homo sapiens
aggcattgaacaaacatttattttttgccttccacatgccaggacctactgcgtctcctccggatgggtgctcctcgccgacaaagtctagattgtgattatctcaaggacttgagttaccctcacttccgacctcctctctcacaaactggttccaggcggggagactgaggatgggctggggaggctggcagaggcgatccccacctcgcggagcacaacatctgctgtgttctgcggcgagcgcctgtcaagcagtgggaggaaaaagcgcttggagccaccagcccactcttaagcgaaactcgcctggaaaacaccccgcctcccagcagagtttctgccggtttctttagaagggtggtgcggaaaagcaacttttgggaacttgaaggagtggggtgtggggcgaagtggaaagagcacacaacgcgaccccactcagtccccgcttgggactcccatcccggcatcaggcgtagtgggcggtccgggccagggccagggccagagcggcggcggcgaggccatgccgagggcccgtcggccgcagttccccgtccggcctcgcgggggcgccggcgctgccgatcaggtgaccgagggcccgttcggggctgcgggaagcggcctcgttctcagccgccggagacgccgccgccgccgccgccgccgccacacctagtggagcagccggggaaggcggctcgttgggggctggggcggagagcgccgggggtgggggcggaagggcggcgggcggaaggcaggaggctgccggggcgcgggctgctgcgggagaaggggctccgaggagtccgccgcggctcgctctgtcgccggcgcgggattggggcgcgagggccatgggcgcgctctcctaaggcggaggtcgcgggcgggaggggaggaggcccgagagaggctgctgcgaaggccgcgggcccgtgactgggcgcgaggcggccggcggcggcggcggcaccagcaccaccatgtcgcgctcagtgctgcagcccagtcagcagaagctggcggagaagctcaccatcctcaacgaccggggcgtcggcatgctcacccgcctctacaacatcaagaaggcatgtggagaccccaaggcaaaaccatcctatcttatcgacaaaaacctggaatctgctgtgaaattcatagtcagaaaattccctgctgtagaaacccgcaacaacaatcaacagcttgcacaactacagaaagaaaaatcagagattctgaaaaatctggcattatattacttcacatttgtagatgttatggaatttaaggcacattgctgaattaatattttacatggaagaacttagagcacatgtgaggaaatacggacctgtaatgcagaggtattacgtgcagtacctttctggctttgatgctgttgtcctcaatgaactcgtgcagaatctttctgtttgccctgaagatgaatcaatcatcatgtcctcttttgttaacactatgacttccctaagtgtaaaacaagttgaagatggggaagtatttgatttcagaggaatgagattagattggtttaggttacaggcatatactagtgtctcaaaggcttcacttggccttgcagatcacagagaacttggaaagatgatgaatacaataatttttcatacaaaaatggtagattccttggtggaaatgttggtggaaacatcagatctctccatattttgtttttatagtcgtgcttttgagaagatgtttcaacagtgtttggagttaccctctcaatcaagatactcaattgcatttccactactttgcactcattttatgagttgcacgcatgaactatgtccagaagagcgacatcatattggagatcgcagtctttccttatgtaatatgttcctagatgaaatggccaaacaagctcgaaatctcatcactgatatttgcacagaacagtgtacccttagtgaccagttgctacccaagcattgtgccaaaactatcagtcaagcagtgaataagaaatcaaaaaagcagactggtaagaaaggggaacctgaaagggagaaaccaggtgttgagagcatgaggaaaaacaggctggttgtgaccaaccttgataaattgcacactgcactttctgagttatgcttctctataaattatgtaccaaacatggtggtatgggaacatacctttaccccacgagaatatttgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtgttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcacactt

SEQ ID NO: 81425 - DNA, 4811 bp, Homo sapiens
aggcattgaacaaacatttattttttgccttccacatgccaggacctactgcgtctcctccggatgggtgctcctcgccgacaaagtctagattgtgattatctcaaggacttgagttaccctcacttccgacctcctctctcacaaactggttccaggcggggagactgaggatgggctggggaggctggcagaggcgatccccacctcgcggagcacaacatctgctgtgttctgcggcgagcgcctgtcaagcagtgggaggaaaaagcgcttggagccaccagcccactcttaagcgaaactcgcctggaaaacaccccgcctcccagcagagtttctgccggtttctttagaagggtggtgcggaaaagcaacttttgggaacttgaaggagtggggtgtggggcgaagtggaaagagcacacaacgcgaccccactcagtccccgcttgggactcccatcccggcatcaggcgtagtgggcggtccgggccagggccagggccagagcggcggcggcgaggccatgccgagggcccgtcggccgcagttccccgtccggcctcgcgggggcgccggcgctgccgatcaggtgaccgagggcccgttcggggctgcgggaagcggcctcgttctcagccgccggagacgccgccgccgccgccgccgccgccacacctagtggagcagccggggaaggcggctcgttgggggctggggcggagagcgccgggggtgggggcggaagggcggcgggcggaaggcaggaggctgccggggcgcgggctgctgcgggagaaggggctccgaggagtccgccgcggctcgctctgtcgccggcgcgggattggggcgcgagggccatgggcgcgctctcctaaggcggaggtcgcgggcgggaggggaggaggcccgagagaggctgctgcgaaggccgcgggcccgtgactgggcgcgaggcggccggcggcggcggcggcaccagcaccaccatgtcgcgctcagtgctgcagcccagtcagcagaagctggcggagaagctcaccatcctcaacgaccggggcgtcggcatgctcacccgcctctacaacatcaagaaggcatgtggagaccccaaggcaaaaccatcctatcttatcgacaaaaacctggaatctgctgtgaaattcatagtcagaaaattccctgctgtagaaacccgcaacaacaatcaacagcttgcacaactacagaaagaaaaatcagagattctgaaaaatctggcattatattacttcacatttgtagatgttatggaatttaaggaccatgtttgtgaattgctgaatactattgacgtttgccaagtcttctttgatattactgtaaactttgatttaacaaagaactacttagatttaattataacctatacaacactaatgatactgctgtctcgaattgaagaaaggaaggcaatcattggattatacaactatgcccatgaaatgactcatggagcaagtgacagagaatacccacgccttggccagatgattgtggattatgaaaaccctttaaagaagatgatggaagaatttgtaccccatagcaagtctctttcagatgcactaatttctcttcaaatggtatatcctcgaaggaatctttcagctgaccagtggagaaatgcccagttattgagcctcatcagtgcacctagtacaatgcttaatccagcacagtccgacactatgccttgtgaatacctctctttggatgcaatggaaaagtggattatctttggctttattttgtgccatgggatcctaaatactgacgctacagcactgaacctttggaaactagctcttcaaagtagctcttgcctctctctctttcgggatgaagttttccacattcacaaagctgcagaagacttatttgtaaacatacgaggctataataaacgtattaatgacataagagaatgcaaggaggcagccgtgtcacatgctggttcaatgcacagagaaagacgcaagtttttaagatctgcactgaaggaattggctactgtcctctctgatcaacctggattgctaggtcccaaggcactttttgtttttatggcattatcctttgcccgtgatgaaatcatctggctacttcgtcatgcagataacatgccaaagaagagtgcagacgactttatagataagcacattgctgaattaatattttacatggaagaacttagagcacatgtgaggaaatacggacctgtaatgcagaggtattacgtgcagtacctttctggctttgatgctgttgtcctcaatgaactcgtgcagaatctttctgtttgccctgaagatgaatcaatcatcatgtcctcttttgttaacactatgacttccctaagtgtaaaacaagttgaagatggggaagtatttgatttcagaggaatgagattagattggtttaggttacaggcatatactagtgtctcaaaggcttcacttggccttgcagatcacagagaacttggaaagatgatgaatacaataatttttcatacaaaaatggtagattccttggtggaaatgttggtggaaacatcagatctctccatattttgtttttatagtcgtgcttttgagaagatgtttcaacagtgtttggagttaccctctcaatcaagatactcaattgcatttccactactttgcactcattttatgagttgcacgcatgaactatgtccagaagagcgacatcatattggagatcgcagtctttccttatgtaatatgttcctagatgaaatggccaaacaagctcgaaatctcatcactgatatttctggccaaacccaagggaaaaaaaaccaaaaagggggggttttggggggcttttaaacccccgtttagtgaccagttgctacccaagcattgtgccaaaactatcagtcaagcagtgaataagaaatcaaaaaagcagactggtaagaaaggggaacctgaaagggagaaaccaggtgttgagagcatgaggaaaaacaggctggttgtgaccaaccttgataaattgcacactgcactttctgagttatgcttctctataaattatgtaccaaacatggtggtatgggaacatacctttaccccacgagaatatttgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcacactt

SEQ ID NO: 81426 - DNA, 5200 bp, Homo sapiens
aggcattgaacaaacatttattttttgccttccacatgccaggacctactgcgtctcctccggatgggtgctcctcgccgacaaagtctagattgtgattatctcaaggacttgagttaccctcacttccgacctcctctctcacaaactggttccaggcggggagactgaggatgggctggggaggctggcagaggcgatccccacctcgcggagcacaacatctgctgtgttctgcggcgagcgcctgtcaagcagtgggaggaaaaagcgcttggagccaccagcccactcttaagcgaaactcgcctggaaaacaccccgcctcccagcagagtttctgccggtttctttagaagggtggtgcggaaaagcaacttttgggaacttgaaggagtggggtgtggggcgaagtggaaagagcacacaacgcgaccccactcagtccccgcttgggactcccatcccggcatcaggcgtagtgggcggtccgggccagggccagggccagagcggcggcggcgaggccatgccgagggcccgtcggccgcagttccccgtccggcctcgcgggggcgccggcgctgccgatcaggtgaccgagggcccgttcggggctgcgggaagcggcctcgttctcagccgccggagacgccgccgccgccgccgccgccgccacacctagtggagcagccggggaaggcggctcgttgggggctggggcggagagcgccgggggtgggggcggaagggcggcgggcggaaggcaggaggctgccggggcgcgggctgctgcgggagaaggggctccgaggagtccgccgcggctcgctctgtcgccggcgcgggattggggcgcgagggccatgggcgcgctctcctaaggcggaggtcgcgggcgggaggggaggaggcccgagagaggctgctgcgaaggccgcgggcccgtgactgggcgcgaggcggccggcggcggcggcggcaccagcaccaccatgtcgcgctcagtgctgcagcccagtcagcagaagctggcggagaagctcaccatcctcaacgaccggggcgtcggcatgctcacccgcctctacaacatcaagaaggcatgtggagaccccaaggcaaaaccatcctatcttatcgacaaaaacctggaatctgctgtgaaattcatagtcagaaaattccctgctgtagaaacccgcaacaacaatcaacagcttgcacaactacagaaagaaaaatcagagattctgaaaaatctggcattatattacttcacatttgtagatgttatggaatttaaggaccatgtttgtgaattgctgaatactattgacgtttgccaagtcttctttgatattactgtaaactttgatttaacaaagaactacttagatttaattataacctatacaacactaatgatactgctgtctcgaattgaagaaaggaaggcaatcattggattatacaactatgcccatgaaatgactcatggagcaagtgacagagaatacccacgccttggccagatgattgtggattatgaaaaccctttaaagaagatgatggaagaatttgtaccccatagcaagtctctttcagatgcactaatttctcttcaaatggtatatcctcgaaggaatctttcagctgaccagtggagaaatgcccagttattgagcctcatcagtgcacctagtacaatgcttaatccagcacagtccgacactatgccttgtgaatacctctctttggatgcaatggaaaagtggattatctttggctttattttgtgccatgggatcctaaatactgacgctacagcactgaacctttggaaactagctcttcaaagtagctcttgcctctctctctttcgggatgaagttttccacattcacaaagctgcagaagacttatttgtaaacatacgaggctataataaacgtattaatgacataagagaatgcaaggaggcagccgtgtcacatgctggttcaatgcacagagaaagacgcaagtttttaagatctgcactgaaggaattggctactgtcctctctgatcaacctggattgctaggtcccaaggcactttttgtttttatggcattatcctttgcccgtgatgaaatcatctggctacttcgtcatgcagataacatgccaaagaagagtgcagacgactttatagataagcacattgctgaattaatattttacatggaagaacttagagcacatgtgaggaaatacggacctgtaatgcagaggtattacgtgcagtacctttctggctttgatgctgttgtcctcaatgaactcgtgcagaatctttctgtttgccctgaagatgaatcaatcatcatgtcctcttttgttaacactatgacttccctaagtgtaaaacaagttgaagatggggaagtatttgatttcagaggaatgagattagattggtttaggttacaggcatatactagtgtctcaaaggcttcacttggccttgcagatcacagagaacttggaaagatgatgaatacaataatttttcatacaaaaatggtagattccttggtggaaatgttggtggaaacatcagatctctccatattttgtttttatagtcgtgcttttgagaagatgtttcaacagtgtttggagttaccctctcaatcaagatactcaattgcatttccactactttgcactcattttatgagttgcacgcatgaactatgtccagaagagcgacatcatattggagatcgcagtctttccttatgtaatatgttcctagatgaaatggccaaacaagctcgaaatctcatcactgatatttgcacagaacagtgtacccttagtgaccagttgctacccaagcattgtgccaaaactatcagtcaagcagtgaataagaaatcaaaaaagcagactggtaagaaaggggaacctgaaagggagaaaccaggtgttgagagcatgaggaaaaacaggctggttgtgaccaaccttgataaattgcacactgcactttctgagttatgcttctctataaattatgtaccaaacatggtggtatgggaacatacctttaccccacgagaatatttgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtgttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcacactt

SEQ ID NO: 81427 - DNA, 4765 bp, Homo sapiens
aggcattgaacaaacatttattttttgccttccacatgccaggacctactgcgtctcctccggatgggtgctcctcgccgacaaagtctagattgtgattatctcaaggacttgagttaccctcacttccgacctcctctctcacaaactggttccaggcggggagactgaggatgggctggggaggctggcagaggcgatccccacctcgcggagcacaacatctgctgtgttctgcggcgagcgcctgtcaagcagtgggaggaaaaagcgcttggagccaccagcccactcttaagcgaaactcgcctggaaaacaccccgcctcccagcagagtttctgccggtttctttagaagggtggtgcggaaaagcaacttttgggaacttgaaggagtggggtgtggggcgaagtggaaagagcacacaacgcgaccccactcagtccccgcttgggactcccatcccggcatcaggcgtagtgggcggtccgggccagggccagggccagagcggcggcggcgaggccatgccgagggcccgtcggccgcagttccccgtccggcctcgcgggggcgccggcgctgccgatcaggtgaccgagggcccgttcggggctgcgggaagcggcctcgttctcagccgccggagacgccgccgccgccgccgccgccgccacacctagtggagcagccggggaaggcggctcgttgggggctggggcggagagcgccgggggtgggggcggaagggcggcgggcggaaggcaggaggctgccggggcgcgggctgctgcgggagaaggggctccgaggagtccgccgcggctcgctctgtcgccggcgcgggattggggcgcgagggccatgggcgcgctctcctaaggcggaggtcgcgggcgggaggggaggaggcccgagagaggctgctgcgaaggccgcgggcccgtgactgggcgcgaggcggccggcggcggcggcggcaccagcaccaccatgtcgcgctcagtgctgcagcccagtcagcagaagctggcggagaagctcaccatcctcaacgaccggggcgtcggcatgctcacccgcctctacaacatcaagaaggcatgtggagaccccaaggcaaaaccatcctatcttatcgacaaaaacctggaatctgctgtgaaattcatagtcagaaaattccctgctgtagaaacccgcaacaacaatcaacagcttgcacaactacagaaagaaaaatcagagattctgaaaaatctggcattatattacttcacatttgtagatgttatggaatttaaggaccatgtttgtgaattgctgaatactattgacgtttgccaagtcttctttgatattactgtaaactttgatttaacaaagaactacttagatttaattataacctatacaacactaatgatactgctgtctcgaattgaagaaaggaaggcaatcattggattatacaactatgcccatgaaatgactcatggagcaagtgacagagaatacccacgccttggccagatgattgtggattatgaaaaccctttaaagaagatgatggaagaatttgtaccccatagcaagtctctttcagatgcactaatttctcttcaaatggtatatcctcgaaggaatctttcagctgaccagtggagaaatgcccagttattgagcctcatcagtgcacctagtacaatgcttaatccagcacagtccgacactatgccttgtgaatacctctctttggatgcaatggaaaagtggattatctttggctttattttgtgccatgggatcctaaatactgacgctacagcactgaacctttggaaactagctcttcaaagtagctcttgcctctctctctttcgggatgaagttttccacattcacaaagctgcagaagacttatttgtaaacatacgaggctataataaacgtattaatgacataagagaatgcaaggaggcagccgtgtcacatgctggttcaatgcacagagaaagacgcaagtttttaagatctgcactgaaggaattggctactgtcctctctgatcaacctggattgctaggtcccaaggcactttttgtttttatggcattatcctttgcccgtgatgaaatcatctggctacttcgtcatgcagataacatgccaaagaagagtgcagacgactttatagataagcacattgctgaattaatattttacatggaagaacttagagcacatgtgaggaaatacggacctgtaatgcagaggtattacgtgcagtacctttctggctttgatgctgttgtcctcaatgaactcgtgcagaatctttctgtttgccctgaagatgaatcaatcatcatgtcctcttttgttaacactatgacttccctaagtgtaaaacaagttgaagatggggaagtatttgatttcagaggaatgagattagattggtttaggttacaggcatatactagtgtctcaaaggcttcacttggccttgcagatcacagagaacttggaaagatgatgaatacaataatttttcatacaaaaatggtagattccttggtggaaatgttggtggaaacatcagatctctccatattttgtttttatagtcgtgcttttgagaagatgtttcaacagtgtttggagttaccctctcaatcaagatactcaattgcatttccactactttgcactcattttatgagttgcacgcatgaactatgtccagaagagcgacatcatattggagatcgcagtctttccttatgtaatatgttcctagatgaaatggccaaacaagctcgaaatctcatcactgatatttgcacagaacagtgtacccttagtgaccagttgctacccaagcattgtgccaaaactatcagtcaagcagtgaataagaaatcaaaaaagcagactggtaagaaaggggaacctgaaagggagaaaccaggtgttgagagcatgaggaaaaacaggctggttgtgaccaaccttgataaattgcacactgcactttctgagttatgcttctctataaattatgtaccaaacatggtggtatgggaacatacctttaccccacgagaatatttgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagcattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtaccttccataacataaaataaacactagactgtatcacactt

SEQ ID NO: 81428 - DNA, 1784 bp, Homo sapiens
  misc_feature (14)..(15): n is a, c, g, or t
aaagaaagaaaaannggaaagggaaaagaaaatacaaaattgaaaaaaaaaggaatcttggtaccacttactgcaaaacttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatatggaggacgttattgaggatataatcggtatggaatcaagttttaaagaggaaggagcagactctcctctgctaatgcaaagaacattatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttcccaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggt

SEQ ID NO: 81429 - DNA, 1487 bp, Homo sapiens
tcttggttattgtttgcaagtttaaggaaaagaaaatgatgaaggagaaagagaaaaccattgctattgtgaaggttatagacacttcaaagttaaaactgttatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttcccaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggt

SEQ ID NO: 81430 - DNA, 1423 bp, Homo sapiens
atcgtttactttggttgtcccttctggcatggtgcatatgttatgggaagagggattataatttggtgctgtttgtagagatgacaacactgataaaatccactcattgctggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatatggaggacgttattgaggatataatcggtatggaatcaagttttaaagaggaaggagcagactctcctctgctaatgcaaagaacattatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttcccaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaatatctaccgtggggaatcctcgggtcaccgagcg

SEQ ID NO: 81431 - DNA, 754 bp, Homo sapiens
tgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatgtatgtctaatggctggttataaaaatatatcatcagtttttgaaaaaacctctattaaagtaattgaagtcaacattttacagtaaacattctgattgcaaatgtaacaaaagaaatgtgcttttaattaattattctctatttattaactatatgcatataaattcctatgcataataaattataaaaattcttgtttaatatgcacttcaaatatgtattaatgtgaattaaaatagacactaatagtggtatgtgtttagaagatttagccctaattgtaaatgttttctgataaatttagttgaaatatttatcagtagttaaattgtcttaaatatccattaacataaaacagacagaaattacttaaatagcagtaaatttttgctgtagaaattgactattagaataagactaataattttattgcacttatatgaaattatatctggatcttttaacttttgcttttctatacattcaattctatttttaataaatagttggctactatttactaa

SEQ ID NO: 81432 - DNA, 1837 bp, Homo sapiens
atcgtttactttggttgtcccttctggcatggtgcatatgttatgggaagagggattataatttggtgctgtttgtagagatgacaacactgataaaatccactcattgctggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatatggaggacgttattgaggatataatcggtatggaatcaagttttaaagaggaaggagcagactctcctctgctaatgcaaagaacattatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttcccaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggt

SEQ ID NO: 81433 - DNA, 1867 bp, Homo sapiens
ggagagaagacttcaaatcagccaggaaatcagtgcccatagaacagagttccacatgcagttttcatacaaaccagtgttgcatagacttgtcccagcaagaccacaaatttattcaagtcaattaccatcctttaccagggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatatggaggacgttattgaggatataatcggtatggaatcaagttttaaagaggaaggagcagactctcctctgctaatgcaaagaacattatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttcccaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggt

SEQ ID NO: 81434 - DNA, 1750 bp, Homo sapiens
atcgtttactttggttgtcccttctggcatggtgcatatgttatgggaagagggattataatttggtgctgtttgtagagatgacaacactgataaaatccactcattgctggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatttatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttcccaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggt

SEQ ID NO: 81435 - DNA, 4979 bp, Homo sapiens
gtggctttgggtccccaggattctggatcgtggttgcatctggagagaaaaaaggatcaatcgacacgttttagaagtgtccgtgggtgaataaaaaaggagggggggggtgcaaaactggggttgcggatgcttaaagcaaaaaaagagaaaaggaagcgtcttgaatcctggaacaagaattaccgggtgctcgagatttcaaaaaagcgtctagaaactggtaaatacttggaccatttcagcttgaatttgacggcgaagtgttgtagagaccgtctccttgaatcattgcaaagggaccggggaaagatgagggggctccctctgtggatttatcttgctgagggatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtccgaagatctttcagagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgtggtttactaataacttggatgtggtttcatcatatgtgcaagaccagagcgaagactgcctatatttaaatatatatgtcccgactgaggatgatattcgggacagtgggggtcccaaaccagtgatggtgtatatccatggtggctcatatatggaaggtactggaaatttatatgatggaagtgtcttggcaagttatggcaatgtgatcgtcatcacagtcaactatcgacttggagtactcggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactggtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatagccagataagagaaacaaactattttttttgatggattgcagtaaacgatcactgaagattccttggctttcaacctacaagacttactatttaaataaggaggaatattatgtgaatatacatatcaagaactttgggggttttgaaaaaaatgaattgtatatatacaaatcaactttaaaaacaaatttcaattgcttgaagcaattgttctgaatgatactttttcattcacattcaagaattaattttttgaagatttaagttacataatggaattaggcatgtggaacaccaaacaggaaagaactatgtctgaaatataaaaaataaaaataaaaaaacaactatgaatatgcacaagggacacaccagtggaatgtcagataattttcaccagtttttatttggagccgttttattgtgtagaccatatttacatatttggataagtacacaaagcgtcaatgctgttaatggccttagcaaaggctcatgctgaaatttgccagtaaaacaaagaagtttaaagactggcaggtacaccattatcacataagtgctgtcagtataaagttgtggggataaaggaaactggatatttttagcacgatgtgcatgataatttatatgcttggtggctgtgctgctgattaagccgtaattaaaattcttctcatcccattggagtttttaatagaagcttcctccatcaattggcagaacctaaagaagattttaaggggcaaaagtaattacaataaaataattcacagtagtttcaatatagaaggaattagctattaaaggtatttgaagaaactataggtatagtggtgaatactcgctgatatgaatcccagaaaaaaatttcctgtttttaatgttcttttcaatcccatctagataatttatagaaatataaccctaattggacatgtggtacaggatctataagttgctgtgtttttttgttactctgtattttgttccttttggtaaggtgaagtgtgtccaaagagttacttgcaacagtctttcatgatatgaggatgcccccgtattaccactctgattatagttctgagttctttgatttactcatgctgcatgacaaaatgtttactaataacaattcattataaagttatatccctctttacatcacttatctttctcactgaggttcattcactggaatttactcacgcaatctcagtagagtacaacgtagatacagaacctaggagagtcaacatctggaggattttagtctttcttacacatatgtgtgattttaaacgaatattctcagaccacaggaaactcttcatccccctgttgtttaccagtaacagtatatcacagacctttccaaatgtttgtatatgtaatcagatgtacatttatattgaaaaacaaatgagatggacttaaagagcacatcctgataaatactttctctctcacctgtactatatttctattagactaaagttatgtgattttttttttacattttttcagatgactagcaattttgatagtttataagataatgcaaagaactttctctgacaaactaactgcagtaacagaaacctttcttttcagttactctttttcaagaatgaaagattattatacaaaaaattgtatactacttgatggaaccaactttgtacatcttggccatgtcactggtcattgtgtgaaataaagataatctggataatgactattagtccaatgctaagaaacatgatctttgctcattaaagagctaaaatgtttattgctgttttgtctttcttttttctaaaaaaagaaaaaaaaga

SEQ ID NO: 81436 - DNA, 3788 bp, Homo sapiens
tgggtgggcagagcaacattgttttgacagtgaaaattaccaatttataattttttaagaaaagcatgcctagcacagaccacctgattaccaagaggaagctgaagaggagattctactagaggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactggtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatagccagataagagaaacaaactattttttttgatggattgcagtaaacgatcactgaagattccttggctttcaacctacaagacttactatttaaataaggaggaatattatgtgaatatacatatcaagaactttgggggttttgaaaaaaatgaattgtatatatacaaatcaactttaaaaacaaatttcaattgcttgaagcaattgttctgaatgatactttttcattcacattcaagaattaattttttgaagatttaagttacataatggaattaggcatgtggaacaccaaacaggaaagaactatgtctgaaatataaaaaataaaaataaaaaaacaactatgaatatgcacaagggacacaccagtggaatgtcagataattttcaccagtttttatttggagccgttttattgtgtagaccatatttacatatttggataagtacacaaagcgtcaatgctgttaatggccttagcaaaggctcatgctgaaatttgccagtaaaacaaagaagtttaaagactggcaggtacaccattatcacataagtgctgtcagtataaagttgtggggataaaggaaactggatatttttagcacgatgtgcatgataatttatatgcttggtggctgtgctgctgattaagccgtaattaaaattcttctcatcccattggagtttttaatagaagcttcctccatcaattggcagaacctaaagaagattttaaggggcaaaagtaattacaataaaataattcacagtagtttcaatatagaaggaattagctattaaaggtatttgaagaaactataggtatagtggtgaatactcgctgatatgaatcccagaaaaaaatttcctgtttttaatgttcttttcaatcccatctagataatttatagaaatataaccctaattggacatgtggtacaggatctataagttgctgtgtttttttgttactctgtattttgttccttttggtaaggtgaagtgtgtccaaagagttacttgcaacagtctttcatgatatgaggatgcccccgtattaccactctgattatagttctgagttctttgatttactcatgctgcatgacaaaatgtttactaataacaattcattataaagttatatccctctttacatcacttatctttctcactgaggttcattcactggaatttactcacgcaatctcagtagagtacaacgtagatacagaacctaggagagtcaacatctggaggattttagtctttcttacacatatgtgtgattttaaacgaatattctcagaccacaggaaactcttcatccccctgttgtttaccagtaacagtatatcacagacctttccaaatgtttgtatatgtaatcagatgtacatttatattgaaaaacaaatgagatggacttaaagagcacatcctgataaatactttctctctcacctgtactatatttctattagactaaagttatgtgattttttttttacattttttcagatgactagcaattttgatagtttataagataatgcaaagaactttctctgacaaactaactgcagtaacagaaacctttcttttcagttactctttttcaagaatgaaagattattatacaaaaaattgtatactacttgatggaaccaactttgtacatcttggccatgtcactggtcattgtgtgaaataaagataatctggataatgactattagtccaatgctaagaaacatgatctttgctcattaaagagctaaaatgtttattgctgttttgtctttcttttttctaaaaaaagaaaaaaaaga

SEQ ID NO: 81437 - DNA, 2689 bp, Homo sapiens
  misc_feature (2689)..(2689): n is a, c, g, or t
tgggtgggcagagcaacattgttttgacagtgaaaattaccaatttataattttttaagaaaagcatgcctagcacagaccacctgattaccaagaggaagctgaagaggagattctactagaggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactggtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatagccagataagagaaacaaactattttttttgatggattgcagtaaacgatcactgaagattccttggctttcaacctacaagacttactatttaaataaggaggaatattatgtgaatatacatatcaagaactttgggggttttgaaaaaaatgaattgtatatatacaaatcaactttaaaaacaaatttcaattgcttgaagcaattgttctgaatgatactttttcattcacattcaagaattaattttttgaagatttaagttacataatggaattaggcatgtggaacaccaaacaggaaagaactatgtctgaaatataaaaaataaaaataaaaaaacaactatgaatatgcacaagggacacaccagtggaatgtcagataattttcaccagtttttatttggagccgttttattgtgtagaccatatttacatatttggataagtacacaaagcgtcaatgctgttaatggccttagcaaaggctcatgctgaaatttgccagtaaaacaaagaagtttaaagactggcaggtacaccattatcacataagtgctgtcagtataaagttgtggggataaaggaaactggatatttttagcacgatgtgcatgataatttatatgcttggtggctgtgctgctgattaagccgtaattaaaattcttctcatcccattggagtttttaatagaaccatctcctgtgcgcaagagctacaacgtgttgattn

SEQ ID NO: 81438 - DNA, 368 bp, Homo sapiens
ataatcattagatcacacccctgtcttccaatcatacttcccactactgtccactcttcaacaaaccagagcataaaagtacacagctttttctgtttctttggtcttctttatttctgaagacccctgtgatatgtaaaacttatcttaaataagtttgtcagcttttctcttattaatcttttgttataggcatctcagccatgaaccttccaataggttagaaaaaggtattacttcttctcccctacagaagcttattgatcaacagagataatactttggaattatgctatctcaagagaagccatgtaggaaggattaagagtatctaatttttttacacaattatacagggatctcctatg

SEQ ID NO: 81439 - DNA, 329 bp, Homo sapiens
gatgtagttcacttataaataccattagattgtgccatgaaatgccttgtatgcaagggaatgttcacatatcaatggcttcctgattttacctctgtttccatttgcctgtgttaaactctagagttctatcattagaataccacattttagaccctggtaaggatgaaggcgcaatgccttgagcataatgagtattaaatatttccctctagttcatgccaaggaagcagtacttttatcaaatggagttctcataggattttcagtattctttaaatttctgaaaaagggtagaggaaatatgaaaacagaactttgaaatgaca

SEQ ID NO: 81440 - DNA, 161 bp, Homo sapiens
ccaaattgcagcatggccaaagtgttgacttgtctatcatactaaaacagcagcaaaccttacactaatacatccttgaacttggacattcattcagcaatcttgactgggctccaaccttggagtgagtgatgatgcctgttaccgaagtggggtacaaa

SEQ ID NO: 81441 - DNA, 550 bp, Homo sapiens
gcatgcatctagtacttgagctatcttaaattctggtgttcatgtggttttatatggcactgagttgtgatgacttttttcctgctattagcctctcagatggatgagaattatttaaagtctgcagtatagtaagatacatttagatacatttagagcactgtataattgactttgcttatattctttgttttggttaaatttgtttctaatcgtagtttaaatcttccctgacaacttaattctggtttatgaagcattattaaaagtgtgtgtggccaggcgtggtgactcataccttcaatccagttttggaggccaaggtgggtggatcacttgagcccaggagtttgagatcaacccgggcaacatggtgaaaccttgtctctacaaaaaattagccaggtgtggtagtacgtgcctgtggtcccagttactcgggaggctgacatgggaggatcacctgagtctggggaggtcgaagctgcagttagctgagattgtgccacagtggtctagcctgggtgacagagtgagaccctgtctccaa

SEQ ID NO: 81442 - DNA, 400 bp, Homo sapiens
agaaaaatgaacaaaaaatataaacagatctatagataaaggaaacaaataaatggctcttttatctacctattggaaagacacttaagaaaactattcctattaaactgacaatttaaataacgtttgataacccactccgttaccaaaagaacaaggaagacagcactcgaacaacaacagggaaacataaacttgaaatttgacagaatctatcaaaatttaagcagtaaacataaatcctttgacccagaaactgtacttctacaaatttatcctaaagaaagactctctcatgtgcaaaagttatatatgtatagggctattcattgtatcactatttgtattagcaagattgtaaacatcttaaatacccatccaaacaaaggaatgctaccat

SEQ ID NO: 81443 - DNA, 796 bp, Homo sapiens
tttcactgcagcagaaggcaaaagagctgacttagtaagcagcaagtgataggatggtgaggtggaggacaacatcctttacacggggcacccgactgtgctatggggctcaagagctgtgggtctaactttctggggttaatttccttgatttcctgtcttctgcacaatcagatcagttttgtgagactaaagccaaaatcctagaagcagaataggttctgatccatccactatcccttcaacccgtccctggtccaacctgtcttactaactaacacttctccttcctcccaacaccactagatcactacaacccatctcacagccccgacaaaaaaggtcacagcactcagctccctccaaggtacagagttcacagtgctggtatcttttcccatgagaagccaggaaaggagagggccatgtgccagctgctgccccacacagtcctctagggcttctggacgagtgtgtagtcccctcgcggcaggtcctgtacatctggtggaccactctatctctgcacagtgtgtctccagccagcacagtgtccagtatgtagcaggtactcatgacacgcttgtggaacaaaggcctggttgcccccacccctaccgttcctctttcctttctgctagatactcatctaggggtaactctatttttagggcctcacccatgactaaatcccagacatcagaactgcttcccagagctgtttggtctgtttttgttttaatctcacgccacagcaaaaattctcatgcaacacccccaaaagctgggaacccag

SEQ ID NO: 81444 - DNA, 465 bp, Homo sapiens
tggcctatccctcagaaatcccacagaatttcctggatggtgttgcattgtttccatacaatagccaaccattgttgtttgtttattttggcctggcaaatcccagctcctccaccccagttgctttctacttaggatgtcttaaaaaggacaaaattctttttctttctctgaatattttaaattcatttgaacacaacagtttgaaacatagttatgctattgtttctttactgaattaaggaaaaagagacttcctttttggcccataatttggtgggttgggggcggggagtaccatgtcatccatctgtttagcatttgcagaaagcctgttcttctcatattaacatactaaggcaaaatccagttccacaaagcccacagtgagagcaaacacctggtggagcccaaagccctggtcagcacttagggtaggagtacaagggccactggctcccttac

SEQ ID NO: 81445 - DNA, 318 bp, Homo sapiens
tcatcttaatgactttttaaaaaattttattttaagttccatgatacacatgcagggcgtgcagccttgttacataggtaaacatgttccatggtagtttgtcgcacctatcaacccatcacttaggcgttaagccccacatgcattagctgtttattctaattttgatagttaccttgactctttgcactgtgttgttatcttgccttttacatgcttcagaggcctattagtgggaagctaagcattctataatcttataataaaatcgctgtcttgtagagggcctctttctctggactgtgacctttgcatagc

SEQ ID NO: 81446 - DNA, 285 bp, Homo sapiens
cacatctcactgtcccaatcagggacaaaagagcatggctgaggattccccaaggggatgtgaattctcaagcacttccatctctccatgttcatgcaaagaaggtgccaggagccccgtggccatcctcccacaaaagacacacaggtggtggcatctggggggtcaatgtgcatggttgtgcatggtagagacccctggatggagctccatgatgtgggatttacatcccgcccatactctgctgtgagagagatggtatgcagccagtccagccatctgaag

SEQ ID NO: 81447 - DNA, 785 bp, Homo sapiens
gtttcgctgtgatctgtgggggcttaaagagcaaagcagatccaccattctgatgattctcaagccaattctttttaactagagagttagtaatcaggataaccccattaggttactggggtgggacagtaaactcttcaagctatctactccccacccccctcctccaaacacacaataacacatggtccccttgacaagctccaaggctggttaatgagtaaaaacctgtcaactgccaggacactgtgtctttcaggccagggctcacaccagccttgcactccacagtctctggagcagtagctagcctctgactccaatgctgtgccatctactcaaagaacagcagcttccccaggctaaggggtatttggaatttggaagccagatctcttggcttatagaggataagaactggacaaaacaaggcttagctctccacaatttgacttaataactagtttttgttttgtttttgagacagtctcactttgacacccaggctggaatgcagtggagtgatctcggctcactgcaacgtccacctcctgggttcaagcaattcttgtgcctcagcctcccaagtagctgggattacaggcatgtgccaccacacctggctaatttttgtatttttagtagagacggggtttcactatgttggccacactagtctcgaactcctggcttcaagtgatctgcccacctcagtctcccaactgctgggattacaggcatgagccacagcacccggccaataactagatttttaaaactcacca

SEQ ID NO: 81448 - DNA, 513 bp, Homo sapiens
gaggaaagtcatgagaagtacgaggaaaaagtaatagctgattagtatgcagatgaggtctacatctgtggttaggggtcatttcaagataaatgaactcgagcataagagtcattgtaataaataaataaataagtaaataaataaagtaaagggaattcatgaagctatatctgaagctacactaacaggcccagaaaccttgcacatttcgtgaaatacctttgctattttgtattgaaaatgcatcttttggctgggtgcggtggctcacgcctgtaatcccagcacttagggaggccgaggcaggcggatcacaaggtcaggagatcaagaccatcctggctaacacggtgaaaccccgtctctactaaaaatacaaaaaattagcagggcgtggtggcgggcgcctgtagtcccagctactggggaggctgaggcaggagaatggtgtgaacccgggaggcggaggttgcagtgagccaagatcacgtcactgcactccagcctagg

SEQ ID NO: 81449 - DNA, 974 bp, Homo sapiens
agctggacttggatgctggcttcatgaccgtgctccccagcgttcccacctggtgatgtccctcccctggaatctgccggaggcccaggactttctgacccacaggatgccccaggaatgacaccatatgacatctgaggccaggtcacacaaagcctggcagcttggcctggcctggtgaacgtgctctggagggagccagctgccacgggagaatccaactaccccgagaccaccatgctgcagggaagcccacgccagccacatgggaggccagccggccctagctgttccagccacccaactgagggcgggggcgaagaggccatcctggacggtccaccccgtttggccttcagacgactccagccccagctgccacctgattacaactgcagagagaccccaagacagggctgcctggctgagctgggcaacccacaggccaggcgataacggggtgctttaaggcactaagctttggaggagtgtttgttacacggcaatagttaacagggaactgggagtcgatttcaagctcacatggccagtccaccctgagcatgtcccctgggccatagttcagaaagcaggtgcaggtcagggttcagggccagtgtgggcctcaatattgtttcctgcccccgtggaggccgtggtggcatttggagggggtccttggaatccatgcccaaggaagcactgaagctgcctgggaccctcccaaacccaggaagggccgtcatcaagaatggtgcccaagaaagtcctgggacttcactgacacacggcacttgcaccagccgtgtagccggatcgtcttactacagactacttcctcagaagggagccctgctggttgggagatagcacctcccggaccacactgcggctatacccggcgctacacgtcagaaagcgccacgcacaccccagagatctccctatactgcgcatacaccacgcacagggca

SEQ ID NO: 81450 - DNA, 437 bp, Homo sapiens
gggaatttctgaggtccaattacagggctagtctcataataagaactaataattcataatgaaattatttgcttttaaacctcatccagacgctgttgtgaaaaatatactaacccaaccacattcctatagggtcattaacacggccagtacaaacaggtgaggtctgctgaagtcatagttctcagagcttctgtgaagagctggatgttggttctgtgacagtatcactacagggcaaccctttcataccagtcctttcatagtatggcatcctgttcttgatgtatggattttgatatccttctcagctcaggtaaatgcccaatgggtatttaacaaatatacaaatagaaactgaatccttgcatcactaaactttgtgttgccttcacacattaagacaacttagctgaaaataaagttcttgggttata

SEQ ID NO: 81451 - DNA, 3047 bp, Homo sapiens
acggggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctcttta

SEQ ID NO: 81452 - DNA, 769 bp, Homo sapiens
cggacgcgtgggtcgacccacgcgtcctataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctctttaagttgtgtatgttctgttggtttttctactatagtttttttaattgtttgtgtaatgtttcataattcagtacctggtgttaggttaggaatcccattcatttatttgttaattagtctgcctaagtccaaaaaggattttaagtagctttaaacctaggcaagaataattgtgactatagagtgcttagattaaaaatttgccactgttgtagcaataat

SEQ ID NO: 81453 - DNA, 3268 bp, Homo sapiens
acggggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctctttaagttgtgtatgttctgttggtttttctactatagtttttttaattgtttgtgtaatgtttcataattcagtacctggtgttaggttaggaatcccattcatttatttgttaattagtctgcctaagtccaaaaaggattttaagtagctttaaacctaggcaagaataattgtgactatagagtgcttagattaaaaatttgccactgttgtagcaataat

SEQ ID NO: 81454 - DNA, 3437 bp, Homo sapiens
acggggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaaggtaacagcgcccggcgcgactcgcagggaaggggcttccgggagagccgggagagccgggagggctgcaggaccggcagggctggagtcgggccgggagctccggaagtcggtctcgcggggcgagccgggcctcggcgcctctccgcgctcctgcttcccgggcgctgccggcctgcgtcctcctccagcccggtccctgctgccgtcacgttgcagattgatccgaaattcgggggagcgaaggaaattggctttcgaggcggcctggttgaagggggcgtgccttccaccgtccccgacagtcgcccaactttcccccttttggtcacgtagggaagagctgggacagtggaggcgactggggcttcagtacgctgtcgagaaccagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctcttta

SEQ ID NO: 81455 - DNA, 3502 bp, Homo sapiens
acggggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaaggtaacagcgcccggcgcgactcgcagggaaggggcttccgggagagccgggagagccgggagggctgcaggaccggcagggctggagtcgggccgggagctccggaagtcggtctcgcggggcgagccgggcctcggcgcctctccgcgctcctgcttcccgggcgctgccggcctgcgtcctcctccagcccggtccctgctgccgtcacgttgcagattgatccgaaattcgggggagcgaaggaaattggctttcgaggcggcctggttgaagggggcgtgccttccaccgtccccgacagtcgcccaactttcccccttttggtcacgtagggaagagctgggacagtggaggcgactggggcttcagtacgctgtcgagaaccagcaagtgaagatgttaaagagatctttgccagagccagaaatggaaagtacagacttctgaaaatatctattgaaaatgtttctgcaccacagtccatttctaatgtcagtgcttccatctctggaatggaaatcactaaacagagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctcttta

SEQ ID NO: 81456 - DNA, 2219 bp, Homo sapiens
cttcgtgggaaaaacattccccaggagggaattttgttagacgccaaaggttttagatttaattcaaggccctggatacctcatgcctgttataagtggacgcgattgctgttattctacttccatgaacctttttgctagaagttggtaagaaagcccacttacaaatggagtaaattagaaaaggatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctcttta

SEQ ID NO: 81457 - DNA, 3104 bp, Homo sapiens
acggggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctctttaagttgtgtatgttctgttggtttttctactatagtttttttaattgtttgtgtaatgtttcataattcagtacctggtgttaggttaggaatcccattcatttatttgttaattagtctgcctaagtccaaaaaggattttaagtagctttaaacctaggcaagaataattgtgactatagagtgcttagattaaaaatttgccactgttgtagcaataat

SEQ ID NO: 81458 - DNA, 795 bp, Homo sapiens
cgggctgcaggaattcggcacgagaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctcttta

SEQ ID NO: 81459 - DNA, 1225 bp, Homo sapiens
acggggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacatagttcagcgtatgacgggtgcgagttcg

SEQ ID NO: 81460 - DNA, 551 bp, Homo sapiens
  misc_feature (27)..(27): n is a, c, g, or t
tgcgcggtgactctgaggatccccgtnacatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctctttaagttgtgtatgttctgttggtttttctactatagtttttttaattgtttgtgtaatgtttcataattcagtacctggtgttaggttaggaatcccattcatttatttgttaattagtctgcctaagtccaaaaaggattttaagtagctttaaacctaggcaagaataattgtgactatagagtgcttagattaaaaatttgccactgttgtagcaataat

SEQ ID NO: 81461 - DNA, 509 bp, Homo sapiens
agttcgacggaagcatgtaattcttcactgctatataaatttactgggaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctctttaagttgtgtatgttctgttggtttttctactatagtttttttaattgtttgtgtaatgtttcataattcagtacctggtgttaggttaggaatcccattcatttatttgttaattagtctgcctaagtccaaaaaggattttaagtagctttaaacctaggcaagaataattgtgactatagagtgcttagattaaaaatttgccactgttgtagcaataat

SEQ ID NO: 81462 - DNA, 417 bp, Homo sapiens
tacgagtttgatagtttgttttatttcttgcaatcagagcccagaggatcatattggggtatgcattcgcatatgttctatgatgttttcattaaccaatatcatttatgctgtagaatctccattcatttttttaaaagtaaaatttctattggactttctgttgcaacactgcgaatgagactctctactagctatcatttatcaagtataaaaatcttaaacatgtgcattgaatgctttcttatctttctcctcttccagtacatgcacaccatgttcttagtaaagaaatctcttaagtctggaacttctgcagtagtataacttgttgagctgtgttgtctttgtacactgtttgtactcctttcaattcagtgcatgatgtttgtgttgcattttctgtccaacagaaca

SEQ ID NO: 81463 - DNA, 830 bp, Homo sapiens
atgcagttatatctgacctccattatttcctggtttgaaattgggcagcctgcagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccataggtatatgatacattgtttttaacacattactttcagtttg

SEQ ID NO: 81464 - DNA, 3756 bp, Homo sapiens
acggggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaaggtaacagcgcccggcgcgactcgcagggaaggggcttccgggagagccgggagagccgggagggctgcaggaccggcagggctggagtcgggccgggagctccggaagtcggtctcgcggggcgagccgggcctcggcgcctctccgcgctcctgcttcccgggcgctgccggcctgcgtcctcctccagcccggtccctgctgccgtcacgttgcagattgatccgaaattcgggggagcgaaggaaattggctttcgaggcggcctggttgaagggggcgtgccttccaccgtccccgacagtcgcccaactttcccccttttggtcacgtagggaagagctgggacagtggaggcgactggggcttcagtacgctgtcgagaaccagcaagtgaagatgttaaagagatctttgccagagccagaaatggaaagtacagacttctgaaaatatctattgaaaatggttagttaaatattttaaaatattttctgttcctggattagtggctgttgtatttttaaacttactgtgtgttgtcagtgatttgaactattaattaatatgaagcaagttcaaatcttacggtaacttggattcctcatattttgtgcaggtccctatgggcccctaatttcattctgaattatgtgactatcagggaaacagaaagatgttttttgatgtgacttcttcctcttttactttttgtgtctcagtttctgcaccacagtccatttctaatgtcagtgcttccatctctggaatggaaatcactaaacagagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctcttta

SEQ ID NO: 81465 - DNA, 2942 bp, Homo sapiens
tgattgttgactcctagaggatcccccttaacattcctagtctcttaactagtggaacgtaatctctggtgttatatcgatctttgattgaaatcagctttagctgtagcatgttgatgtgttctttacctgcccggtctctggtcctgactagcaggctccacattcctggaaattatgatgtttatgcctctgtgagaaccctattgtacaggaggtacagacctccaatacataatccaggtcatattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgaggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctcttta

SEQ ID NO: 81466 - DNA, 3068 bp, Homo sapiens
acggggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaagcaagtgaagatgttaaagagatctttgccagagccagaaatggaaagtacagacttctgaaaatatctattgaaaatgagcaacttgtgattggatcatatagtcagccttcagattcctgggataaggattatgattcctttgttttacccctgttggaggacaaacaaccatgctatatattattcaggttagattctcagaatgcccagggatatgaatggatattcattgcatggtctccagatcattctcatgttcgtcaaaaaatgttgtatgcagcaacaagagcaactctgaagaaggaatttggaggtggccacattaaagatgaagtatttggaacagtaaaggaagatgtatcattacatggatataaaaaatacttgctgtcacaatcttcccctgccccactgactgcagctgaggaagaactacgacagattaaaatcaatgagagcccagaggatcatattggggtacagactgacgtgggtgtggacactaagcatcaaacactacaaggagtagcatttcccatttctcgagaagcctttcaggctttggaaaaattgaataatagacagctcaactatgtgcagttggaaatagatataaaaaatgaaattataattttggccaacacaacaaatacagaactgaaagatttgccaaagaggattcccaaggattcagctcgttaccatttctttctgtataaacattcccatgaaggagactatttagagtccatagtttttatttattcaatgcctggatacacatgcagtataagagagcggatgctgtattctagctgcaagagccgtctgctagaaattgtagaaagacaactacaaatggatgtaattagaaagatcgagatagacaatggggatgagttgactgcagacttcctttatgaagaagtacatcccaagcagcatgcacacaagcaaagttttgcaaaaccaaaaggtcctgcaggaaaaagaggaattcgaagactaattaggggcccagcggaaactgaagctactactgattaaagtcatcacattaaacattgtaatactagttttttaaaagtccagcttttagtacaggagaactgaaatcattccatgttgatataaagtagggaaaaaaattgtactttttggaaaatagcacttttcacttctgtgtgtttttaaaattaatgttatagaagactcatgatttctatttttgagttaaagctagaaaagggttcaacataatgtttaattttgtcacactgttttcatagcgttgattccacacttcaaatacttcttaaaattttatacagttgggccagttctagaaagtctgatgtctcaaagggtaaacttactactttcttgtgggacagaaagaccttaaaatattcatattacttaatgaatatgttaaggaccaggctagagtattttctaagctggaaacttagtgtgccttggaaaaggccgcaagttgcttactccgagtagctgtgctagctctgtcagactgtaggatcatgtctgcaacttttagaaatagtgctttatattgcagcagtcttttatatttgacttttttttaatagcattaaaattgcagatcagctcactctgaaactttaagggtaccagatattttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaatactcagatttaaaattactttaaagtcctggtacttaacaggctaacgtagataaacaccttaataatctcagttaatactgtatttcaaaacacatttaactgttttctaatgctttgcattatcagttacaacctagagagattttgagcctcatatttctttgatacttgaaatagagggagctagaacacttaatgtttaatctgttaaacctgctgcaagagccataactttgaggcattttctaaatgaactgtggggatccaggatttgtaatttcttgatctaaactttatgctgcataaatcacttatcggaaatgcacatttcatagtgtgaagcactcatttctaaaccttattatctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagatggtgaataacatattcccagtaaatttatatagcagtgaagaattacatgccttctggtggacattttataagtgcattttatatcacaataaaaattttttctcttta

SEQ ID NO: 81467 - DNA, 644 bp, Homo sapiens
acggggcggggcggccgcgggtcgcgggcggatgacgcgccggggccggcggaggagcagccacttcctggggccgccggccggggccgctggctgcactcagcgccggagccgggagctagcggccgccgccatgtcccaccagaccggcatccaaggtaacagcgcccggcgcgactcgcagggaaggggcttccgggagagccgggagagccgggagggctgcaggaccggcagggctggagtcgggccgggagctccggaagtcggtctcgcggggcgagccgggcctcggcgcctctccgcgctcctgcttcccgggcgctgccggcctgcgtcctcctccagcccggtccctgctgccgtcacgttgcagattgatccgaaattcgggggagcgaaggaaattggctttcgaggcggcctggttgaagggggcgtgccttccaccgtccccgacagtcgcccaactttcccccttttggtcacgtagggaagagctgggacagtggaggcgactggggcttcagtacgctgtcgagaaccaggcgagttttctttttcatggtccaaaggagaatattacaggactttgattacaaaaagaaccatgccagaatctttctcacatcagtaggggtgct

SEQ ID NO: 81468 - DNA, 527 bp, Homo sapiens
cttaatacacaaatgcacacttttaaaaagtgtggctcatatggttcacatttttccttttgtcttgttggttttaggtttctagctctatactttctaatccatttctacccctaccgttgtacccagaatccagccttctagtgaatggaacagggtttattcgttcaaacattattgaaccagctaagggacgggattctaaggcctctaatgaataaggcagagttctgcactcaagaaataaggaagatgaacattttaggagagttcagagttgccagttagtaactgcctttgggagtcaggagtttgagaccagcctggccagcatggcgaaaccccatttttgagactctgtctcaaaaataaataaataaataaaataaaaaataagtcacgactgggcacagtggctcacacctgttatcccagcactttgggagtctgaggtgggaggactgcttgagctgaggaggtagagccagcttgggcaatacagcaagacctcatctctactaaaaatt

SEQ ID NO: 81469 - DNA, 413 bp, Homo sapiens
cttaatacacaaatgcacacttttaaaaagtgtggctcatatggttcacatttttccttttgtcttgttggttttaggtttctagctctatactttctaatccatttctacccctaccgttgtacccagaatccagccttctagtgaatggaacagggtttattcgttcaaacattattgaaccagctaagggacgggattctaaggcctctaatgaataaggcagagttctgcactcaagaaataaggaagatgaacattttaggagagttcagagttgccagttagtaactgcctttgggagtcaggcttcacattgcagataacatttgactttgttcttgaataagattccacgaggccaggaaatggcacaccagaatgcacaacacaaagtaaaagtgcactgaggc

SEQ ID NO: 81470 - DNA, 199 bp, Homo sapiens
tatattcttaaaaggtgatggtagaaaatgagtctaaaaggtttcagggaagtcggggacggggtggggggagattcagcagctacaaaatttaaaactactgggcttgactcccctcccctactcccttccaccttctgtttcctccccttatttaccccctccccaggctggaggaaagggaacagctctagccaac

SEQ ID NO: 81471 - DNA, 851 bp, Homo sapiens
cacacacacacatactgatatatgcacacacatataaacttaaccttggggttggctgctgtcaaacagttctgtcatccattcctgatgactcacaccagagaaatagatatataagtaaactggaaaactacaaatcacccctaaatcatttctttccaggaatgaggatgtgatttttcagcaactcaacatttctattagcttatttatcccacacatcttctccttcccaatactgaaactagttgaaattccctgaagtgacggcaagtgaaagaaacaggttagagatgagtggaaaaaagaaacagtccaggattttaacagattttcatggttgggaggtcatcaacattcagacacccaaaaatcaacaatatctatagacccctacactgcaggggaggtaaatgactacaataactcttctgtatctcagagaacatacaggcataaagaatggccaagtaatgtgctatctgacaaataggacaatcagcagtatacaacattatcacatggtcttacaacatcacagcaaaattataacattgctttacaatgagcaaaaatccttttcgttcctggccagcaacttgattgtaatacagatacccaatattttaagaatcatggaagaggatgcctacccaaaacacttagaatttccactacttttagtggtacaactgattctgtgaatacagacaaacaggaatgcaggaaatgctagaattcattcgtcaacctgaaataatttcccccaaataaaccctgaatgtgttagaattcaagagtgatgcaaaccattgtctaagcccatagtctcagaggaaagcacatttatt

SEQ ID NO: 81472 - DNA, 1025 bp, Homo sapiens
attttaataatatgagcgtgttaaacattaaacagaacatgatactggctgggataagattagagaattgaaacaaatttggggaatttccaataaatactagaaaattagactagaaaaatagctgttatataaataactttgttggaatatgctaattttagtgtcttgaaagtttacaatttatctgattgctctgcagtacagtagcaactgagctgatcaataaaggtgaaattactttttcattaattcgcaatttcaaaatctgtccaaatgttcttggtttttaaactttatgtagcattcttttttttttttttagacagagtcttgctctgtcgcccaggctggagtgcaatggcgtgatctcagcttactgcaacctccacctcctacctcagcctcccgagtagctgggactacaggcacctgccaccacatccagctaattttttatatttttagtagctatggggtttcaccgtgttagccaggatggtctcgatctcctgaccttgtgatccaaccacctcagcctcccgtagttctgggattacaggcgtgagccaccgcgcctggctttatgtagcattcttaaagtcactagggagatggcaggtgaagtaaaggcagatttccaaaatcactaattttttttagttttttgtcacttaacctttcttgcatatacttctttccacagctcattttcttacttgtatattaataaagctaactcatcttcctgaatatacatgattttacatgagaagagcaggaagcttaggcttggttagctaaaactaagatattgctgcccactaatcacacagggataaaactaatagactgttaagattgtcagtactcaataggaagtataaagcgttctagtctattgtgtgaatcaggttccaaaaaatcttaaatacataaaatggataaaaaggctgggcgccgtggctcacgcctgtaatcccagcactttgagaaacccaggtgggcggatcacctgaggtcag

SEQ ID NO: 81473 - DNA, 437 bp, Homo sapiens
atgtagaaacataaatttttcaagatttggtttttctatgagtatggccaagaaggaggtaaacggaactgtcagactttttttctttctttagacagataactgtgatgtctgttatacagatccctgccagaagtactgaacatagctttaaaaattgtgactgttggggtttcgttattaattagctttgtttatatagtggttacacattaatgtcttctaacttttagtatatgttaggctgtttgccctgttggtaactggcctccagttatgaatggagtgtaacaaacagaaaagtgaaccactcatagtgtgcagctaaactaccaaccagtcttgttttggtataaattattgctctgtggttctttcccattcagtctctcctggggtgtccatttctttctagctttctgtaatggctccctcat

SEQ ID NO: 81474 - DNA, 136 bp, Homo sapiens
ggggaggcggggggccgggcgcactcccccgcgccggcggccgggcccccgccggactgcggagagcgaggctgggagagagcgagcgcgacggcggcggcggcggagagaggctctttgttgcctccctaccccg

SEQ ID NO: 81475 - DNA, 822 bp, Homo sapiens
caggtatatggcatgaagtctagagatctaatgtataatatgaggactatagttaatgatactgtattgtattcaggatttttgccaaaggagagtatcattgctcttgccacaaaaaataaaggaggtaactatgtgagatgatggatatgctaatttacctgactatagtagccatttctctatgtacatgtattaatatatcaaaacatcaagttgtataacttaaatatacacacaaaaaataaatttgtatgttttatactccttccacaatggtcaagattccttaaatcttagttgaaattatggtcatactatgtaagaggcaaaaacatgacttaagggaacattagagaggagtaaatataatataaaagccctactgaaaatgaggagaaaacaaagtgtctgtacccttataaagagtgaaagccctgcccccttctcctatagaacccctagcaaggagactggaagaatcaaaaacaatccacccaaaaaatggcctgcagggacacagtcccagagaaagagactatgtacaacaaggtacagtaagtaagacctgcccacacacaggacttccaatcgacttcttagtgcttactcctacagatgaacagatcaaccagggccaccagatgctccaggaaagacaggagtccaaaaagaaaattcggtaagtttgaatatattttgagcaaattttcagttctgttgaagtattggggggacattcaacagtgagtagtagtttagggggaacagctggcacctctggcagtcgcctcagaggtcaaccagcgtgtaggttgcttt

SEQ ID NO: 81476 - DNA, 193 bp, Homo sapiens
tctgttagcagccactgttctagtgcttcatatacgtccgtgaacaaaacaaaccattacacaataagtgtttattgagtgctaactgcttgtcagagcccatgctattaagtgctgtcatctgtttaacatttattgatcacctgtgtaaggtactattctaatctgggatatgtcagggaacaaaacaaaa

SEQ ID NO: 81477 - DNA, 839 bp, Homo sapiens
agtcgcggggcctcctccctggggtgtgagcaggtcggcgcgccacacttctctaggtggccggacgcgcgcccagggaggagctggcggcggggcccaggctgttccggctgcggcacgccaggggatgtggttagccctgagcctggaggccgaaggtgggcaggcaacactcccaccgtgtttcggaggagaatacactaggctagcctaacgacactcggagtgcgagctgcggctggggtaggggcacccctttccagcgggcgcgtgggtcaccaaggagcagttctccgggacccgttgcgtccgagggactgggcggggctgggcggggcaggacgggggcggcgctcaggagccctggaacccgctggccctgaggccacggaccgaggcgtggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggtttgtttagggtcgcagaagcagggaggactgactcagccctcacagagaagaggtctggaaagtcctggggaactcgcagggcacgggccgctgtcgcggttgggaggcgagggcgcagcgctggggttgtagattccaagacccctgagggtggctgtgttggtttctcgcaggagtcggaggctccctgctctccagccgcccagtgacccaagcttaatcttcagcaccacttggggcgaccttttcggtgcaaacc

SEQ ID NO: 81478 - DNA, 384 bp, Homo sapiens
aaaggggatcatgtcagtagagtatttataaataattcatgggaaaaggtcttggtagtatacttacaacttttctgttagtctgagatgtttcgtgatcaaatgaatgtttgacttattaaatttataaattaaaaaccctagtttcatacactttataatgtataaattttattattctatctatagatttgaccaaattttaacaatcacttctatgagtccttgtatagtttaactaaattcctttgaacattttaaattttaattataaactttattgtatttaattttctaagaattttaaatttttacctaaaaataagccttcccatgcatttaaatgactattgtaaatctaataaaataaatataatgaccctt

SEQ ID NO: 81479 - DNA, 267 bp, Homo sapiens
gtgccattgtactccagcctaggtgatgaatgaaactccgtctcaaaaaaaaaaaaaaattgaaagtgtttaagcccaagatgaaactgaattctatttaagagttgtgcttatgtgtataaagcaaagaataacataggcaaacggaacaaaactatagtaattggggaaacgcaactcatacctgtggaaaccagtggcatggtttgtgtcaaattctgaagcagccttcctggtaaggctactggacacagaatacccttcaag

SEQ ID NO: 81480 - DNA, 570 bp, Homo sapiens
gagtgcaggtggaagaaaggagagaaggtggatttaagagatactgaacataaaggactagggagaagaaagagtctagggtgactgcttccatgcttgagtgctgagtagacaatattgctcttaaccgaaattggtggggaatgaacaggtttggaggaccctaagtcagtgaattagtggtgtttgccggactttaggtagcaatgttagttggcaatttgaagtactcaagagacatggaaagcatgcgcatatgaggactgggtagagaaaggagaacccacaatggggatgataagtaatagagaggacggtaaagggagccaggcccacaggcaccgagagaccactgggcagatgctaccgtgcgtgtgcttaaatactattctatggcagaccgagtttctaaggtttgaacagaaaaacaacagagtctggctcatgcctgtaatcctagcactttgggaggctgaagtgggcagatcacttgagctcaggagtttgagaccagcttgggcaacatggcaaaactctgtctctacaaaaagttagccagacatggtgcca

SEQ ID NO: 81481 - DNA, 705 bp, Homo sapiens
ggcagacttggtttctgacagtgggcaccctgggcagggaagctgggcagggctgctgaagtctggtgggagccctggatctgtgaactctcacttctaggagggactgtgacccccacttctaggaggggctatcctctttctgctaaccttcagcctgctgtgcattcctgttagaagtcatagctactgtcatttgtgctggtggaactaggaaagcagtgttcctctcaagatattatggggtcccagggagatgcagtgtccagggaagcagaggcagcagcacagctgcaggaagaagtcagggtggaatccacacagagcgcattcccaggtgagcatgtaggcccaggggcgtgggctgtaattccttatgtattaaaataaagtagattctgtttcatagtcaccagctactgaagtcagcaatatatacaaaatatacattagcaaagcacaacttcttcttctgtctcaaatgtcttgttgctcctaccaattacttgccctgcttaatagatactcttcacaatggttaactcagtatactgtaggtcatacattagtagaaacatgctcttataatgagcgtgatcatggtaggtgccaggcaagtacactccaagcccagatgtctaggaagatatatagggtcgggtggcaattggcaagggaatttggacctgaggccagtgtcctcct

SEQ ID NO: 81482 - DNA, 432 bp, Homo sapiens
tgagccctgaaccctggacaagtagctaacttttgtttccttaaccttacagtctgtcttagtctataagggggcatgtattttcatctctcagatcacaccacattcctcctggactgggtgcctggccagctctgaagccttcgagtactgactctgagagaaacactggttgattgaagtcttggagtttgcttgagtgtccttttcagctctccctttctagaacagaggttttctgtctttaccctgtgggtaagagatttgtgtttcagggggaaataactgccttttccacctctgcatcaggacagaaggtttgggtcacagtcaggcaaagagctccccagagagcttctgccttttctgcctctattcctcagcaggaagttctgggtcaaggtattggcaggtaggccctggtggttttgt

SEQ ID NO: 81483 - DNA, 300 bp, Homo sapiens
cataatgttcccgtagtgtgccctgatgtctatggttgagcaaatttatttagggttgagcaactgaaaaggtaagccaggagagtgctaagaagctgcagcagatgtttccatttgtcctcctgaaggagcacttcctctctctacgatgtctccaggttggaaatatttcccgtgccaccctcctgggttacacatgtgtaggtgtgcaatgccttagaaaaagagattgatctcagctcactgcagcctctgcctcccagcttcaagccgggtgcagtggctcacacctataatccc

SEQ ID NO: 81484 - DNA, 599 bp, Homo sapiens
ggaggaaacgttgaggccaaatcccagtcataaagactgcacaaatgccatggggaggtaggcagaaagttgcaaacaagtgggtttgtatttcagataaccatcttggggctgcaattctaaagttagatataatcacacaggtgagaatagggctgctggtgcatggcaagcgccctccacattccctctggtactgcataggcatgagcctgcaggctaaatgtcttcccatacttcagacagaggctaggggagacagggctgactggtggccaaatgtcaaggaaagtaactttttaatacgatatattcctttaagtgacttgtccgtttttagccatcaaattacaaattaagagctagtgattctgcagtaacacacaccaattcctcgaaaaccttctaaagtcacaccagtttaataattccaaccttagggaaacaaagccaaacatattttaacaagtttgaactttgacctttctattgcttcatctctcctcagtgctgtttattctatatagtttttaaaatagtgttattatataactagtataaaatatttgaaaatccatgggactatataatttaaaaag

SEQ ID NO: 81485 - DNA, 922 bp, Homo sapiens
cggcgaggccgtgctggaacccgggcctcagccgcagccgcagcgtgggccgacatgacgacagctccccagtgagccccccgcccggcccctccaggcgggcagtggagctggcccggcgcctgggcgcgccatgcgcagcaccactgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgtgacgcttaccaccgtgggctttggcgactatgtggccggcgcggaccccaggcaggactccccgggctatcagccgctggtgtggttctggatcctgctcgggcctggcttacttcgcctcagtgctcaccaccaatcgggaactggctgcgagtaggtgtcgcgccgcactcgggccagagatggggcgcgctcacggcttcagggctgccaagctggaactgggcacatgtgacagcgcggcgttgaccagcgagccggggcccgcccggcccggccgccgcacgaaggaccagcactggttgccttcagc

SEQ ID NO: 81486 - DNA, 938 bp, Homo sapiens
  misc_feature (673)..(673): n is a, c, g, or t
  misc_feature (682)..(682): n is a, c, g, or t
  misc_feature (684)..(685): n is a, c, g, or t
ccccgggctgcaggaattcggcacgagataagatagtgacacctccaccacacgtcaattccacacacatttattaggtacctgtgaagcaggatcttatcctcttaaacttccacttctcacactagagagaaagataaggaagatgagcaagtgcctggaatggggcaggctgagtggtcacacaggcacagaggcacactgagaacctacaggggagactgcagagtgccttccctgatgctgcagctggaagtcatccttccctccacctggcccctgagacactctactctgtagtgtgcagtctgatggcactgctagatttctttttcagctcagggccacagcttaaacagctttacctttcccctcagcacctgtcccactaccttgcacacaggtactctatccgtgtttattgaacaaaggagggaaactgatttcactttcacttggttcattatcattccaatttttatgtgaaaatggcacaacccatttggggtacactcatctcaaaagaaaagcccaagactacctctgactggtaccaccttttttgtgggttccttggtgagaaacctttatctttttcatacttttctattctccatcactttctcactagccatggattatcgctagtagaccttcctgtactggtatactnatattgtananngtggagcaaaggactggcccttacttgcgatgactggcacatagagcataggctcttccagagactgcggtgctcgggaaagcctatttcttcgggtcaggggcaaggatggttagacaattattgaacacccctccaaatagcccagtaggccagctgagaaggactggatgctaagtttaaattgaaattctaacttctctttccgggttaaggtgtttgaagaaagttttgccaagttcttggaatcaca

SEQ ID NO: 81487 - DNA, 1259 bp, Homo sapiens
ccccgggctgcaggaattcggcacgagataagatagtgacacctccaccacacgtcaattccacacacatttattaggtacctgtgaagcaggatcttatcctcttaaacttccacttctcacactagagagaaagataaggaagatgagcaagtgcctggaatggggcaggctgagtggtcacacaggcacagaggcacactgagaacctacaggggagactgcagagtgccttccctgatgctgcagctggaagtcatccttccctccacctggcccctgagacactctactctgtagtgtgcagtctgatggcactgctagatttctttttcagctcagggccacagcttaaacagctttacctttcccctcagcacctgtcccactaccttgcacacaggtactctatccgtgtttattgaacaaaggagggaaactgatttcactttcacttggttcattatcattccaatttttatgtgaaaatggcacaacccatttggggtacactcatctcaaaagaaaagcccaagactacctctgactggtaccaccttttttgtgggttccttggtgagaaacctttatctttttcatacttttctattctccatcacttctccaaaagtgtctctttccagctctgatttattcaaaacacacaaacattcctgtttagagattctagcccatggattatccggctagttagtacctctcctgttcacttggttatactttattattgctcagaggttggggaggcagaatgactgtgtcccctcaccctggcagaatgactgtgtcaccactaggagccattagggcttcttcccaggaggactgcctgcttgctttctggggactagcccttatttcccttctgtggtccagtggggcaagtgatttgtattagacaaatatttataagaaacaaccccctccccaaaatagagccaccaagtaaagcacaagcctgaaagatgatgaactatgaattgtctctagtggatataaatttctgcaaatatatctcagtctttctctcttttctctggtgattaaaaagttggtttttggtaaggaaaaggatttttgaccatagagttatgcatcatggaaattcaaacccgatttcttaatacctggtcttctccgaagagaaataatgatagtaatagtggtgctgggaacaatatggaagattattgaatgaaatggattaacttgaataaaatgctgtgaattatctctag

SEQ ID NO: 81488 - DNA, 386 bp, Homo sapiens
ggcagaagaatcgcttgaatttgggaggcaaaggttgtggtgagctgagatggtgctgctgcactccagcctgggagacagagcgagactccatctccaaaaaaaagaaattatgtaatttccatgcgtcttttttctttcactcgatagtgtaataggcagcttttaaatttccaagaggagaaactttgttgttgttaataatttacaggtttttttcattgtgatcagagaatattgcttttgttttgcaaaacctattgatactttctgaggcccagtgtatgtcagcttttgtaactcctccatgtgtacttgatagaagtgtattttcttgggtcttggtatagagttcactgtgtgtgtgtgtatatatatgtacgtat

SEQ ID NO: 81489 - DNA, 164 bp, Homo sapiens
ctcctgtgaaggtggccaggagggagaaggtgctggggctgtgcacctcgtgggcagcctcgggctgtgtcccccctctccccggacaccctctgcaaaggcccacacacacccctctcagttaatggcatccggtaccctaagagcactcatgaacccgggtg

SEQ ID NO: 81490 - DNA, 900 bp, Homo sapiens
aaggaattaatttgatctaaattgaactttaaaattctggtttttcttttttctttttttaagacggagtctccccctgtcacccaggctggaatgcagtggcacaatctcagctcattgcaacctccacctcccgagttcaagcaattctcctgcctcagactcctgagtagctgagattacaggcatgcaccaggacacctggctattttttttttttctttttttagtagagatggggtttcaccagttgatgaggctggtcttggactcctgacctcaagtgatccacccccctcagcctcccaaagtgctaggattacaggcatgagtcactgcgtcaggccaaaattctgtattttcaattagagtcaaagcccaaggatgtctctaccatcttgtagcccttgccaatagcctactcttgtcttccagggttcctccaaatctctctccaaatatttgttatctactcattcaatacccttcttcaaccatcctcttgctttggaattgacatgaaccaactaggcccgccttattggtaggaattcatttgccctgcctgccagcccccatagagacagaaccattgcctagtgaaagaagattttaatgacgtgatgaaaatattttagaaagcaccttgaagattagtatttttatgtaacttctgttggagagatgtcttcaggagactgaagtagaagagcgactgtcaaaatggaaagtcccagagacatccaatttatgtaaatcaacatcacctgaattcagaatctcatccagatttcaacaaagacttctgaatgccaacaaagaagaggactgaatttacagactctcactctaacaatatatgctgttcaatttgaaaacagaataaaattattttggcag

SEQ ID NO: 81491 - DNA, 392 bp, Homo sapiens
  misc_feature (376)..(376): n is a, c, g, or t
aggagcccgcgctgctgactattgttggagcggggtgcattggctctcctccctcaacccgtcttgacacccgcagctgacaaggagaggtaaaatagggcacccaaactactctgcgctttaccctctcaaacacttgtttttaaatcctttgcatctagtcagtcattcaacatgtatcaagcaccagcagctattcgtagcacagctgttaagacctggaataataaaaccttaagactatttggcaacttactcctgaaaggtagtatacggataatttcatctgtaacacgcagatgaggaaattgacctcacagatttaatgtaaattcagagtttacaccaatttaaccgcaacaaatagtcagcagcngggatcctctagagtc

SEQ ID NO: 81492 - DNA, 606 bp, Homo sapiens
aggagcccgcgctgctgactattgttggagcggggtgcattggctctcctccctcaacccgtcttgacacccgcagctgacaaggagaggtaaaatagggcacccaaactactctgcgctttaccctctcaaacacttgtttttaaatcctttgcatctagtcagtcattcaacatgtatcaagcaccagcagctattcgtagcacagctgttaagacctggaataataaaaccttaagactatttggcaacttactcctgaaaggtagtatacggataatttcatctgtaacacgcagatgaggaaattgacctcacagatttaatgtaaattcagagtttacaccaatttaaccgcaacaaataaggagctgtcaatatatatttaataaggaacacacaaaaaaaaagctgaataaatccacttcctaccttctgctccagttgcctctgccagctggtgaaagcttaaggaactgagccctcttagcctcgaggatgagaggtatagagaaacagatcacccaataaacattattcccaagttgaagagcccacatgccctttgagaatgggctggatggtagtaaacacagggccagaggg

SEQ ID NO: 81493 - DNA, 385 bp, Homo sapiens
tagaaggcttgttggacagggcaacattctgtaaagccggccccatggaggcggtctgtgatggaagcagtctttgatatggaactgacgctcctctgggaagcacctactgtgtacctggaccactggctcctgggtggatgcggcggcaaaaaccagacaccagtccttccttgcgctctctacctaccattatccttggccttgattactctgctctatatcatcatcttgcataccctaacacatgacttttatactcatggctccatctgttataaacatactgacaaataaggtttcctctttagcagtgatttcctgatctaatcaatatttgggtatcatataaactcatgggattatcagcgatcatcactaataa

SEQ ID NO: 81494 - DNA, 248 bp, Homo sapiens
aaataaataaataaatggatggatggatagatagcattctgggatgttatgtcagtgatcctgagaaatgttcaaggcctggcttaaggcaataacaaaggggaggggaagatttgaaagatacttaattggtttcagtgcctagtcagtgtcttgagtctagtatttactagattattaacatcataaagaccaagtttagtcctcatcattccttcagtagtaacaaatattaaatgcctgctatg

SEQ ID NO: 81495 - DNA, 413 bp, Homo sapiens
aacactaaagtatcactttataaattcagaaaatccagagtagggaatttctggcccaaggccggagctttccagttgaagtctttattttgcatattctgtggcttttctgttttagttctacttgcttacatttatttttgctttccatagcttgacataatataaaactgaatatatcttagttgtactttgcattgactatttaattttttgtctttttaacttaaaatgtgaaataaaattaatcttgtcttcattactgtatctctgatagtttttgtttcttcatctgttgcttaaatttattccattgtattactgaaaccctaaaaaaaccaagacaccttggaccaagactagtacagtttttattctagtacagttgctgactgtgtgtttgtatgtgtgtt

SEQ ID NO: 81496 - DNA, 411 bp, Homo sapiens
agtttatccaataagattaataaagatttgagaaatcctagcctacagaatatattcctacttgtacaaagtcaccggttataaagtttctgaataaatacttaaagtatttccaaatacaattcacaacgatcccaagcttgaataaaaatgatttttgcggccaggcacggtggctcacgcctgtaatcctagcactttgggaggccgaggtgggcggatcacgaggccaggagatcgagaccatgctggctaacacggtgaaaccccgtctctactaaaaatacaaaaaattagctaggcatggtggcaggcgcctgtagtcccagctactcgggaggctgaggcaggagaatggtgtgaacccgggaggcggagcttgcagtgagccgaaattgcaccagtgcactc

SEQ ID NO: 81497 - DNA, 499 bp, Homo sapiens
tagggtaggatgaggggtcgatagaggacacatggcaccacctggtaaccccaaactccagcagctagcaccagacctgacacacaggttctcaaaacatatgtatgatggaataaatcaatgcatgaaaccgagcacagccacttttttgcctttgcagactcagagaacagaaatcccagcccttcatctctcaggccagaaacccaggcatcatctggggattcctcctacccattctccaattccaatctccattcctgtggcatctcttgacctgcctgtttctccccatccccactgcccctgtcttggtccaggccaccatcatctctctcctggacattgtggcctcctcccaagttctcttccagcctcccatcctggcctcctctgtccatcttccactctatctctaaagtgacttttctaaagcactaatctgaccatgtgaatgctttcatccctcagttcaaaacactcccctgggctgggtgca

SEQ ID NO: 81498 - DNA, 143 bp, Homo sapiens
tataaaaaatgaagagaaaaaagcaaaaatcaaggtaataaaatgttaaagcaatgaagatcacttttatttattttaaataactatcataaatatttatgtattgaatgacagcatcagaatatataaataaataattttta

SEQ ID NO: 81499 - DNA, 205 bp, Homo sapiens
ccccaaatgaccatcagccctcatctaaaatatttcttttgtggttttggagcctctgcagaaatgtgtccagaaactggcaatttgctcccaattcttacggcagcctgttttaccttgaggcacccctgtcagaaatgtcgtcctcttttctcttttcttttttatttttttttttttttttttttttttttttttttttttt

SEQ ID NO: 81500 - DNA, 794 bp, Homo sapiens
agacaggcgacagttcgtgagcaccaacttctattccacggaggcagacagcgaaaaccatttcataaccatggcaaggcatgagagaagcacagggtagctgcaaagttttggaaaagacctctgcaacaactggaagcacagtgtacccaagtggcatggtgcagagggcagaaagaagacaaagaacgaagataaaagaagcctttttcctcaagaagattgtaatctagtggtggagctggaaaataaaggaaagcagtggccatgtatgtcatgaggacattccagtaaccccatgtggtaaggaaccaagtcagcctgccaacaaccactgaaaaactgagccctcctgctgacagccatgtgagaggaacacctgggaagtggatcctccaggcctggtcatacttcagatgactgcagcccaagccaacatcttgcttgagtggagcctcatgagtgactcagtcaaaaccacacagctgagatatttccaacccacagatactgagataataaatgtttattgctactaggtttccttccttccttccttccttcctttttctcttctcttctccttccttccttcctccctccctctcctcctcctccgtcttcttcctcttcctcttcttcctcttccccttccccttcctcttcctccttctttctttcttactttctttctctttctttctttctttctctatgaaaatatcaggtgtactatattttacctgccttcatgtatatttgaataattccataataaaactttttaaaattca

SEQ ID NO: 81501 - DNA, 324 bp, Homo sapiens
tggcaagttggtactaagttccaatgcaaagtctcacacacacttttctctctctctcccaaactgatagattctttctctgcactgtgctgtactgcccaagtttgggggagcagtgtacaggcaatgtgggactgtccttcctcccctctccaatgtgcctcttcttgttattatggtaaaatcaggtagtatgatctctcacctgatttctttagttcttgtgaaggtgttgtcttacatgaattattattcaatttgatgttcttgttgggggatacttgtcagagggttctattatgccatcttgctctaccttttcct

SEQ ID NO: 81502 - DNA, 141 bp, Homo sapiens
gggtgagaggagaattctgcccccatagcttgtcaacatctcttcagcttggtggcccacccagtccacccagcagagcgacctgccccacaccagtggctcgcatgggccttcttatctccttggcccagctgaatcttg

SEQ ID NO: 81503 - DNA, 748 bp, Homo sapiens
ctttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacaccc

SEQ ID NO: 81504 - DNA, 286 bp, Homo sapiens
atatactaactgggtttgtgtacatatactttgtgatgttctcatgatgatgcaattgcctaacgacgtatttctcaaaacttattctcgctattatgcaacgcgcgactgtatctggaggaatggactgcataagccacctctctcccctctgctataccctcattgaccccaacctttctagcagaagctcataaatgtcatggtaggcctgagattgtctggctttagaggtttaacatcaactggttcctctgtaataggggttagtaaacttttcttaaac

SEQ ID NO: 81505 - DNA, 462 bp, Homo sapiens
tctggggacagatcccagctccaaatggcagagtctctacagattacaagccaaatacttcacactatgtgctgatcttcaggaagtcagtctatatttcataacaagtcacatggggataatgaaggaatggcctaaaatgctctcagtaatattcctgagtcatccctcagggctgggcttggtgttatgcatggcggggaagggagcagagctgtgtgcagaggaagatgcagttcttgccttgtcaggatccctgacctgatggcgacccatggtggagtcttcatagtgacagacaccactgtaaaagcagatccaggttgtgcaaccctcaaagcaggtctcctcactcaccgggatagatagactattggccgtacctgcatccaccgcttgccatggtttcgttgtgggtggaggatactttcctgtcccctggctttgggtttgcccacgtgg

SEQ ID NO: 81506 - DNA, 684 bp, Homo sapiens
tggtgcaggagaaagtctcactaagcctggagagaaggcactttaatatttttcacactgttatccctgttaacacatcttgcctcagttgacaaatttctgcttctttcacaggggtcaaacatcagactaaacgtggaacagtgtgcctcagactaagactgcaatcatacaacggaaataaaattgttttatttaaccaattagtgacaagggagcaatcaagttgttttcttggcactgtgtatccaattctatgactatgattttcacctttgaagaagttgcattctgttttcaggaagacaatctttggttgccttcctcacatcattttctgccttttcaaagtcatgactagcgaatatattagaaattttctatataaatcataaatttgcctctgaatattataacaatattttattcattttcatacatcatttgactcttctgccctcattattttgttctactttgattgtatgtttggcccagaacactgagtgaaggaggcatgcaattgctgttttgagggtaaccagcaggccaaagttaatttacacttggtggatttccaactgcagaggagttggtgaaattgtcattggagcttttattttgaaatattatgcagttttgtgctaccacatgtttaataagattgaactaactgagcacttg

SEQ ID NO: 81507 - DNA, 472 bp, Homo sapiens
  misc_feature (46)..(46): n is a, c, g, or t
  misc_feature (58)..(58): n is a, c, g, or t
  misc_feature (97)..(97): n is a, c, g, or t
  misc_feature (114)..(114): n is a, c, g, or t
  misc_feature (152)..(152): n is a, c, g, or t
gggaaggagaagtctgctatgggcatctagcaggtacagggcaggnatgctgacaaangtctacaatgaacaggacagccccacaccacaaagaatnatctagcccaaagtgtnatagtgccggagttgagaaaccgtgtttcacagtgatnacacatgacatcactaaatacaaaagaaagaatttgaatctgcatatcttgccagatgccttaagggacaaaatcacttcagcctgaaccactgctgtaaagattcaaacaataaataaatatatgacttaagtagtgaaagaccctcctccatttgttttggggggaggactctccataggttctagttatctactcaaatgattgtcacccccacacattttatttatttatttcaatagctttggggtacaagtcgtttgtggttacatggatgaattctatagtggtgaattctgagaccacctcccccgccccca

SEQ ID NO: 81508 - DNA, 942 bp, Homo sapiens
agactgaaatgtgttgaaccctgaaggcactgaaggcatcgagtgtgcagtgttttctgtttaataggagatggagtctcgctctgtcgcccaggctggagtgcagtggcgtgatctcggctcacttcaaccttcgcctcccaggttcaagtgatgctgctgcctcagcctcctgagtagctgggattacaggcatgagccactgcccccggcctttactttagagtctcccagacatttcctagtcattcaagcaatacctttacaatttaaccagctggactatcacatacttaatatttttctttcaaatcatttttcattcattttgtttaacctaagcaataatacctgaagtcatgggtttgatggactacttatgtattttcaagtgcccattaagataacaaaatattaaaatgagaaaagattattcatctactctctaagatttccttagttaccaccagttgcacatttggcactctaagaaacaattgctttactggattcctgcacctgcagcctcctgcactttttgagtgatactctgttgatgtttcctttgtctttcctcagacaggagctatactccagaacactgtggaatctctcagcaagacctggtgtgctcaggattccagcttagcttatgagagagcttttctggcagtgtcagtgaaacttcttgagtacatggctcacattgctcctgaagtagtgggacaggtggctatccccatgacgggtatgatcaatgggaaccaagccatccgggagttcatccagggccagggaggttgggaaaatctggagagctgaagagttggagctattcacgagactgaacatcacttccttgttgactgattgggtgattgattcctgggaattcaaacaaacaaataaaaaagcacttttttcattttatcagaactgaac

SEQ ID NO: 81509 - DNA, 294 bp, Homo sapiens
cagaacttatgctgtcatagagcactcctttccatttacagggtcagtgaaagccttaataagagctacatttcctggagctatctgcagatcatttcctggtttcttaggaagttcctgaaagcaattcctttgactgtaggattttctctgtcttccctaggaaaatctggagagctgaagagttggagctattcacgagactgaacatcacttccttgttgactgattgggtgattgattcctgggaattcaaacaaacaaataaaaaagcacttttttcattttatcaga

SEQ ID NO: 81510 - DNA, 784 bp, Homo sapiens
cctttctgagcagctgtgtttgaagaaagctagtgggaaaagttccaggattacatgtcaggaaactacaagaggtagaaacatttgttgatttaccagtgtttttaacttcctgctgggctgaaaactgcttgtttcgtggaaaagcaaaacttgacagcaaacatctaaaatgaagagctcccaaacttttgaggaacaaacggaatgcattgtgaacactctactcatggacttcttgagcccaacattgcaggttgccagccggaacctatgctgtgtagatgaagtagattcaggagagccttgttcttttgatgtggctatcattgctggtcgccttcggatgttgggtgaccagttcaacggagaattggaagcttctgccaaaaacgtcattgcagaaaccattaagggacagacaggagctatactccagaacactgtggaatctctcagcaagacctggtgtgctcaggattccagcttagcttatgagagagcttttctggcagtgtcagtgaaacttcttgagtacatggctcacattgctcctgaagtagtgggacaggtggctatccccatgacgggtatgatcaatgggaaccaagccatccgggagttcatccagggccagggaggttgggaaaatctggagagctgaagagttggagctattcacgagactgaacatcacttccttgttgactgattgggtgattgattcctgggaattcaaacaaacaaataaaaaagcacttttttcattttatcagaactgaac

SEQ ID NO: 81511 - DNA, 451 bp, Homo sapiens
gaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaataaaatgtcaggcttctgagcccaagctaagccatcatatcccctgtggacctgcacgtgcacatccagatgggccggtttcctgccttttctgatgacattccaccacaaatgaagtgaaaatggcctgttcctgccttaactgatgacattct

SEQ ID NO: 81512 - DNA, 251 bp, Homo sapiens
atcaacgaacccattattttcctaatgaccaatgcatgttacaaaatcatatgtggataaaagattcactcaaagtacaagacagactaatggttttaatgtaatataatacaaaaagttcactgatatggtttcagattctacactgcaactaacctttaaagaaccaccactggccaggtacacggctcatgcctgtaatctcagcactttggggggctacagtgggcagatcgcttgagcccaggagt

SEQ ID NO: 81513 - DNA, 331 bp, Homo sapiens
ccaggctgctggggctctaagagactagagggggaaaagtgctgagtgtctcagtatatactatgcctaggtttacttttctttttagtatagggaccctggcatcctccaatccagagaccctccgttttaccctcttctgagaacaaacttccagacctctgctggaagaagggagggtagtttcccaatggcatggttgaggggtggggtatgatctagggatctaactgcttcttaaacagcttccaaccagtcttatttttagcctccccctcctttaactcccatttccataggtatctggtgccaattattcctaagccttttg

SEQ ID NO: 81514 - DNA, 761 bp, Homo sapiens
cccggccgggggcagcctcgccgccgctcagctcgggaatccctgccccccaccagcacctcagtgggggatactgcaagttcaagaattggggccaggatcaggtggtgacagagccacctgggtttccggagactctcaagccaaccccaagtcatgacaaatgccagtcgccttggacagaggcaagggcctggacgcagagaccagaggcctgaactggcagactgtcctcacaggctgtgtgacgctggctggtcgtcccatctctctggggccccacaggactggggaccaggtcgtggaatgacagtggaccacagtggtccggggaccccgctcgttggtggcaggcacaggcccgtgtgatggggacaatgagctttggtggtttaaggcgtgaatgaatgaaggagcaagcagtaagccccgacagcaaggccaccacagccctcgccccacagggacgcctgagcaaggacccaagcaggggacaagcaggctcaccccgcccttgcggggctgaccacgaggccccgtccggtggaacacgccatgacgcttcaggaggctcatgtagctggcgccgtatgggacagcgggggagagagaaaatgcacagcccagggaatgtggagacaggcccagcgccaggcatgggggccggaaggagcagccggggagcagggggcagggcctggagtcccgccttgcagatctgaagcgtgcccagcccaggactctgaggtgcagcaagaggg

SEQ ID NO: 81515 - DNA, 647 bp, Homo sapiens
cctgtatgagctgggtattctgtataagctgtgatatcccttataaactagggtatcctgtatgaactggggtatcctgtatgagctgggtatcctttatgaactggggtatcctgtatgagctggggtatcctgtatgagctgggtatcctttatgaactggggtatcctgtatgagctggggtatcctgcatgagctggatatcggttatgagctgagctattttgtatgaactggggtatcctgtatgagctggggtatcctttatgaactggggtatcctgtatgagctagggtatgctgcatgggcctggtatcctgtatgagctggggtacgctgtgagacctgggtaccctgtaagatctggggtgccctctgcaagctagggtaacaaatggacccgtgtgtgttctgaggactgtagaggtttatccctctcaggtaaaaatccacaggaatattccagccccacaagtggctctgctccaacgaagtcattcaagaagcaggctctgtccaagttgtgagatcctttttctgtctttccctatggcaatgtctatctctgcatggccagaagttttcatcaagaaagcagggagagggtgtggatgagacacatccataggttaagagctaggtgtg

SEQ ID NO: 81516 - DNA, 1004 bp, Homo sapiens
tcaaattattacaattaaatggttgggcaacacagtgcaaacacatttggcacgctcttgttgcccaactttcaaagtattggatctcctcccaagttttagactgggaatgtccagcaaactctgtgccagtgataagagaagagctggtagtatccagttcagttcatggtaaaatctaatctccactagaaatctgccatcttgaattgtcccttgcaatgtttcaattagcaagtaagtacaatccatatgtctgcagctgtctgtcacacctttctttttcctgttataaaagtgcatgtatgtgcatttgcacatacacacacgctcctaagcagccaacaactcttaaacaatcctatctatgagtacattctaatacctgtaaatttaatttggcaagcaaaactggagcaataaatcacaaacccaattctatcatgtatttccagagaaggttaaaggcgaaagaccatgcggaatgctctatatttcctatggttaaagtgggagggagagaaggacaaagggagagagggaaagagaaggaagagaaggaggagaacaggagcgtggagggagggaagaagagaaagaagatgaagggaggggataaaagaagctaggtaatatcttttatttctgtaagaatatacccaatgtttctcagttaaaccaagtgctgggtcttatcagacaccagctccttcagccaccataggaacaccagatgggaggtagatgctcagcgcaaaacaaaagagcaagggtatcagacagccacagaccactccacagcaagggcccgtatggagttacttggtttgtcactaccccctatcattttagtacaagacctagtagaatcttttgacacatcttactatttgttgtaatttagcgccttggttgtgtttggtgggaaattatgtaggcatacaataaaatctcagcaatctacatttacctgaagttatttactatatttattattgtctagt

SEQ ID NO: 81517 - DNA, 655 bp, Homo sapiens
ccaggctggagtgcaatggcactatctccgttcactgcaactttcacccccccgggttgaagctattctccggccttagcctccggagtagcttggattataggtgcctgccaccacacctggctagtttttgaacttttagtagagacagggttttgccatgttggtcatgcttgtcttgaactcctgacctcaagtgatctgcccacctaggcttcccaaagtgctgggtttaccggcgtgagccaccgcacctggccctaattttgttttctacatttgccaggtatcattgaatgagggggtttaacagcttaaaggaaaacaactaagaacactacttaagaaagataagaggccaggcgaggtggctcatgcctgtaatcccagcactttgggaggccgaggcgggcagatcacgaggtcaagaaatcaacaccatcctggctaacaaggtgaaaccccgtctctactaaaaatacaaaaattagccagacgtggtggcgggtgcctgtagtcccagctactcaggaggctgaggcaggagaatggtgtgaacccaggaggcagagcttgcagtgagctgagattgcgccactgcactccagcctgggcagcagagcgagactccgtctcaacaaaaggaaagataaga

SEQ ID NO: 81518 - DNA, 280 bp, Homo sapiens
gtctttacaaagctgggtcttgggcctctgggaagagccccgtctagtaccttgaaggggtgcaacatgagactgattttaggagtggaaaataactggaaattggaaataactgccatttccaaagcgaagggctgtagctggggtgatgccgactagaacagtgagcaaacaggaagaagcatgccccttctgcctcttgatgttttctgtcactcccattagtagaacacagtaggaagccagctagccaaggagaaatgatgtttgtagagtccca

SEQ ID NO: 81519 - DNA, 2775 bp, Homo sapiens
acagccagcgccgccgggtgcctcgagggcgcgaggccagcccgcctgcccagcccgggaccagcctccccgcgcagcctggcaggtctcctggaggcaaggcgaccttgcttgccctctattgcagaataacaaggggcttagccacaggagttgctggcaagtggaaagaagaacaaatgagtcaatcccgacgtgtcaatcccgacgatagagagctcggaggtgatccacaaatccaagcacccagagatcaattgggatccttggcagatggacatcagtgtcatttactaaccagcaggatggagacgacgcccttgaattctcagaagcagctatcagcgtgtgaagatggagaagattgtcaggaaaacggagttctacagaaggttgttcccaccccaggggacaaagtggagtccgggcaaatatccaatgggtactcagcagttccaagtcctggtgcgggagatgacacacggcactctatcccagcgaccaccaccaccctagtggctgagcttcatcaaggggaacgggagacctggggcaagaaggtggatttccttctctcagtgattggctatgctgtggacctgggcaatgtctggcgcttcccctacatatgttaccagaatggagggggggcattcctcctcccctacaccatcatggccatttttgggggaatcccgctcttttacatggagctcgcactgggacagtaccaccgaaatggatgcatttcaatatggaggaaaatctgcccgattttcaaagggattggttatgccatctgcatcattgccttttacattgcttcctactacaacaccatcatggcctgggcgctatactacctcatctcctccttcacggaccagctgccctggaccagctgcaagaactcctggaacactggcaactgcaccaattacttctccgaggacaacatcacctggaccctccattccacgtcccctgctgaagaattttacacgcgccacgtcctgcagatccaccggtctaaggggctccaggacctggggggcatcagctggcagctggccctctgcatcatgctgatcttcactgttatctacttcagcatctggaaaggcgtcaagacctctggcaaggtggtgtgggtgacagccaccttcccttatatcatcctttctgtcctgctggtgaggggtgccaccctccctggagcctggaggggtgttctcttctacttgaaacccaattggcagaaactcctggagacaggggtgtggatagatgcagccgctcagatcttcttctctcttggtccgggctttggggtcctgctggcttttgctagctacaacaagttcaacaacaactgctaccaagatgccctggtgaccagcgtggtgaactgcatgacgagcttcgtttcgggatttgtcatcttcacagtgctcggttacatggctgagatgaggaatgaagatgtgtctgaggtggccaaagacgcaggtcccagcctcctcttcatcacgtatgcagaagcgatagccaacatgccagcgtccactttctttgccatcatcttctttctgatgttaatcacgctgggcttggacagcacgtttgcaggcttggagggggtgatcacggctgtgctggatgagttcccacacgtctgggccaagcgccgggagcggttcgtgctcgccgtggtcatcacctgcttctttggatccctggtcaccctgacttttggaggggcctacgtggtgaagctgctggaggagtatgccacggggcccgcagtgctcactgtcgcgctgatcgaagcagtcgctgtgtcttggttctatggcatcactcagttctgcagggacgtgaaggaaatgctcggcttcagcccggggtggttctggaggatctgctgggtggccatcagccctctgtttctcctgttcatcatttgcagttttctgatgagcccgccacaactacgacttttccaatataattatccttactggagtatcatcttgggttactgcataggaacctcatctttcatttgcatccccacatatatagcttatcggttgatcatcactccagggacatttaaagagcgtattattaaaagtattaccccagaaacaccaacagaaattccttgtggggacatccgcttgaatgctgtgtaacacactcaccgagaggaaaaaggcttctccacaacctcctcctccagttctgatgaggcacgcctgccttctcccctccaagtgaatgagtttccagctaagcctgatgatggaagggccttctccacagggacacagtctggtgcccagactcaaggcctccagccacttatttccatggattcccctggacatattcccatggtagactgtgacacagctgagctggcctattttggacgtgtgaggatgtggatggaggtgatgaaaaccaccctatcatcagttaggattaggtttagaatcaagtctgtgaaagtctcctgtatcatttcttggtatgatcattggtatctgatatctgtttgcttctaaaggtttcactgttcatgaatacgtaaactgcgtaggagagaacagggatgctatctcgctagccatatattttctgagtagcatatagaattttattgctggaatctactagaaccttctaatccatgtgctgctgtggcatcaggaaaggaagatgtaagaagctaaaatgaaaaatagtgtgtccatgcaagcttgtgag

SEQ ID NO: 81520 - DNA, 753 bp, Homo sapiens
ctcaagcacagagtccattgggaagggaccacccaaaagtgtggaatcggggagacagaaacaaattggagtcaccactccgccagtctgtcacagcgttatgtgtgtctgcatacgtgtgtgcttgccgctggcgctcttcatgaattcgttagcaggttctctgcctggctgctggtgatctcgagcaagttgtttcccttctgtgggactccatttccttatctgaaaagtggacagttgggcttgattcatggttttcaaactgctgggaaatgaccttcccagacttgggcactgtgggttcccaggccaaaacatggcagccgaggcccaaatgggagatccccacaaaacacatacaccagacctcctctttatttctgtcccccctgcctctctcctatgcccctatttctcctgagaatgctcccaacttcaccaagtgtttatggagcccaagaggttctgcccctggggaaaagggggaggcagaagaggtagaactttgggagttcacagctctgatatcaggagcagccccatttttctctgttgtctctgggtggttgctgaggctccttcgctctggcctggagagacctcatgaccagtcattccatatgtccccagcacccatagccatttgcttagaggtttccctgtggagtccaccccagccaaggggcattttttcttttgtgcggcattattcccacataggcttcattgaaactttccttggagccccct

SEQ ID NO: 81521 - DNA, 1080 bp, Homo sapiens
cggccgcctctcaccaccagggggcgcgctccgcctgggcccagattccaccccttgactgtctccccccaaaaatttcctttcactttcggcacgggctgtcacccggcttggccccttccacacccaactggggcaagcctgacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctaccaaaaaagg

SEQ ID NO: 81522 - DNA, 1134 bp, Homo sapiens
cggccgcctctcaccaccagggggcgcgctccgcctgggcccagattccaccccttgactgtctccccccaaaaatttcctttcactttcggcacgggctgtcacccggcttggccccttccacacccaactggggcaagcctgacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctaccaaaaaagg

SEQ ID NO: 81523 - DNA, 1086 bp, Homo sapiens
  misc_feature (1)..(1): n is a, c, g, or t
  misc_feature (3)..(3): n is a, c, g, or t
ncnggggcatgagggtccgagacttgttcttctgtcccttccaagacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctgcggagccttaaacaacgcagtgagacagacatctatcatcccattttacaggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctaccaaaaaagg

SEQ ID NO: 81524 - DNA, 350 bp, Homo sapiens
  misc_feature (1)..(1): n is a, c, g, or t
  misc_feature (3)..(3): n is a, c, g, or t
ncnggggcatgagggtccgagacttgttcttctgtcccttccaagacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccaacgccagaatccagcaccggccccatttacccaactctgtacaaagcccttgtccccatgaaattgtatataaatcatccttttctaccaaaaaagg

SEQ ID NO: 81525 - DNA, 344 bp, Homo sapiens
gttggatccgaattcggatccaccggatccaacgttggatccgaattcggatccaaaggcctcatcctgcggagccttaaacaacgcagtgagacagacatctatcatcccattttacaggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctaccaaaaaagg

SEQ ID NO: 81526 - DNA, 347 bp, Homo sapiens
cggccgcctctcaccaccagggggcgcgctccgcctgggcccagattccaccccttgactgtctccccccaaaaatttcctttcactttcggcacgggctgtcacccggcttggccccttccacacccaactggggcaagcctggtgcgtgaggagacttggactctaggtccccaagggcggagccagggtccccactcctggggcaggggagcagagggtggggggctgggttcccgggtccctaacctgggaggttctgggaccagacgtcgagttcttagttcttagaagtggagatgaagagttttcaccgtaactggggcagacgcaggaagcctggggga

SEQ ID NO: 81527 - DNA, 1162 bp, Homo sapiens
cggccgcctctcaccaccagggggcgcgctccgcctgggcccagattccaccccttgactgtctccccccaaaaatttcctttcactttcggcacgggctgtcacccggcttggccccttccacacccaactggggcaagcctgacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgccaggcctgatcctgttttctcccgcagtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctaccaaaaaagg

SEQ ID NO: 81528 - DNA, 758 bp, Homo sapiens
ctaaggtgatccaccagcctcagcctcccaaactgctgggattataggcatgagccaccgcgcccggggaaatatagggaacatttctatcatggccacgttctcttggacagcaatgccctagcacatagtaagcgcttgctgggaatggagttgttttgggcataaatctgtggcccgccccaagctaagctactttccctctcctctctcagcggagccttaaacaacgcagtgagacagacatctatcatcccattttacaggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctaccaaaaaaggccaggtctgtctatggatgggtgtgaatggggtagttttgatttcagaatcttggtttttgaattgcaatgcaatgtttcattcaatacgtgttttctgaggtcccctggagccccgggccggcgctgggcaatgtcagagcctggatttgagtcagaaccagcccaggtgccccaggtctccttggctatggacgagaagacaagggattcagcgagcctgggtgcaggatgccataggctactatggagataaaacagaggcagtg

SEQ ID NO: 81529 - DNA, 733 bp, Homo sapiens
cccgatcacggccgagggcggagctccccaccagtgccatgccgtccgccagcactcctcagcccttgggcggtcgatgggaccgggcaccgcgaagcagggtgcgacgtctgtcgcggaggctccggccgcgtggaagcccacctggggcgtggggggcggcttgggcatggcgggctgcaggtcccaagctctgccccgcggggaggcggttgaggcccagtgagaattcaagcacgacgtgggcgggtgggccagcagtgcaaggggacccagcacaccctccgaagctgctggcctgggtgctaagcccctcactgcctggggctggcggcgccagccggcggctcccagtgcggggtccgccaagcccgcgagcgccgcgcggagccatggttcccgcccgcgccactcgtcccacacctccccgcaagcagagggagccggctcctgcttctgccggcccagagaggggttcccactgtgcagcggcaggctgaagggttcttcaagagtggccacagcggatgccgaggccgaggaggtgctgagagcgagcgagggctgctagcacgttgtcacctctcactatgagcaagccctctgaatataggataaagtctagggttgaaggggcattcagaaagtggaggaggacctgctcttgagctggggtaatttggggagctctttcaacaccagatctttcaaaacttacctgtcccctgtccca

SEQ ID NO: 81530 - DNA, 750 bp, Homo sapiens
ctatcgaaggacacatgatacaatgaggtcaatgtaccaggtttatcatctgggttcatattcctgctcctttaccttgtaagctgtcacttaatcctttatagtctttactgctctgaattctatcctgtggatgataatacttgattttaggatttgttggggaaaccgagcatgggagatacttaatgagcactgattaaattggttaaataataatgaaatgtttttaggccagtatttttaaatggtgtaaattggaaagatttttttaaggattaattctatgtagggtattctatatgtggtaaaatgtcaagttgaggtatttgaataattctattaaattctataataaatgaaaagaacctggaataatgcttggcacatagtcagtgatgatcaaattttaacttttattacatgattatccacagcagtaagttcacttgttcttgctctaatgaaaattgtgagttaggtgaattacctctcaaataatttttccctccaaaaatgtgcattccataaattggtcttatttgatccttaagtcaacaaaatgtgtgtgtatatacgtatgtgtgtatatctttaagtcaactaaatgtgtgtgtgtttgtgtgtgtgtgtgtctgtggggtgtgaaatcgtgtcaaaaaagaatgggaggcaatggtaggagagctacaagctgattgttcagcagtagccacttttcttcccttcccatcatgaatagaatatact

SEQ ID NO: 81531 - DNA, 469 bp, Homo sapiens
gtgaactgtgggtagtgatgtcagtgaaaaatggagaccaccagcacaatccaggctgttgtagcacatacagccttttcaccattttagtctagtcagaaaattagagaccttatgctactagtatgataatagtgatacaattttcagtgtgtgactcctacaactcctctcgctctactgtgcatttgaatagttgagtagcatttttaggaaagtcctcactattttactttgcatgattttctgatcaaggcagccaaaagcacagtaaatgacagagcagaaatcttgatctggaaagggagatttggaacatatcttctggaagaagtgtcttctagatgctaattaacaggcaaaaacgtaataaagactaattttgtagagtattgttgccttacggttgttgccagtgtggctcagtaattgcataactgagtatgttgggtcttctctagtttgatct

SEQ ID NO: 81532 - DNA, 437 bp, Homo sapiens
ttattggtctttcttttgcttgggtacttcttattgtagtcttgtttatttctctaactctttcatatcttaccccttcaacctcatatttaatttgatagttccagtgagcccctttaaactctttcaacacagctttttttttcctcaagttcaagcccacacagttaccatttttttcctacttttcttacttttttattggtgagggctgactttgtaggggtacaactcatgcaactgcacagattctgcactctttaacgaccccaagtttgagctaatatgctgcagtcatcgtcatcttggcattttaatagtttttaaatagaaactcccacattaaattttgcaattgccccctaaaattacatagccagtacagttcctgacttatcattttgacttgtccttccgttttggcataaatacctacg

SEQ ID NO: 81533 - DNA, 741 bp, Homo sapiens
tttgaatcctctgttttatgagtgctgagatatcatctcatgatcccgaacagctgaacagtaaccccctgacactgcagggattacttggcctttatacaacacacagtagctcttcagggacacttagggctatttaatttgcattgtgatcttcagtttgagaaccttaaaagaaaaattaaaagtgcaattgcacacatgaaattacagagtaccattctagcaaacctacatttgtaaactttaaaacacaagttttaccccctgtattgtatattcaaatatatagtaaatgtatcagagtatttgcccattagatatagtcaacctaatattaacaattctgaagagtttcttcagcaaaaatgtatcaaaagagtaataaaaacactgtgcgtgtttcaagcttgtaaaccaatgatgtgctgctgtggtgccaacagagacttccaaatggattatgttaaatggccgtcatttcatttcccaaggttgattttgagcagtatacttggtggaactgaaaacaaagaaattaaccatgtatagcaaattcaaggtttctttatagaaaatctttcagcctccatcttattaaatagtgacaatgtggtaagttttgaattacatgaactcattttgtcatagatttcaattaagagtaataaatagtattaattattctcttctatgataagaagtatatcttatgcttatttccgctggaacatatatata

SEQ ID NO: 81534 - DNA, 728 bp, Homo sapiens
gatcaggtctccacagcagcggaacaacacttttctggacagaaagttaatttacatgaaggaaaaacggtctggtggaaggataccagaactaaaacttgggaattaagaaaaattatgacgcggggaagggcttttgcttgtgtttcaccaggagacaatcaaacacccatttagatacccaatagacatttgaaattctgcaatgaaccctacaccgaccggacagaagaaagggaagaatccaaagaggaagaagactggtccctccgacctgtcctttcgggagctgagaaagatgacgaagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaggacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttcca

SEQ ID NO: 81535 - DNA, 515 bp, Homo sapiens
ttatgcatacaaaaggactgatttcaatctctctattttataaaaggctttcactgcaacagacagccagcgcttgagaaagagaccaaagttaaactaaaaaaaaaagtttacatgacagaccagataaatcaaatgtctatccaatcttagatgctatagtaaaatcaaatatggcaagacaatattttagtttacactcatcacagatgtcattcttttaagtttctaaaagaacactgctctttcaaagctttaaaacactgtcaatactaaaacgaatggtataaaaagaactttttggggccacacagaacatttacattacgcactgatgtttttgacatctgtgaataaagtattcttcgctacggcaagaataatcttttactgtttgacaagcaggtaaaggatgggtgaagggtttatcatctgaaaccccagtctagtgatgagatggtaaatgaaaagactctgctgttgcatcaacactcagctaccaccaagagcccttc

SEQ ID NO: 81536 - DNA, 2064 bp, Homo sapiens
aaagaatttgatacaatttagcattgattccaaattttttaaaaccagtaacaaaggagaatagtatccttaacaggataaaattatctatgtcatgtcaacagaaggaatcatactgaattgtgaaatattggaatcatctcccctaagatcaggaagaaaacaaagatggctgctatcaccattattatttaatgttcttctagaagttttggacaatgtcatattatatgacttagaaataagaattataactatctgaaaggaagaaatgaaattatcactatttggaaatgatagaattatctacctagacaaaaggtttaattaaaaaacatttggaattaataagaaaatttagcagaagatctagttaaaagataaacatcccaaagccaaaaattgtgttatataatcatctccaataagaagctgtgacagaaaaaagatctcattcaggagagcaataaaaaacagaatatctagaaataaccttaaaataatttgacagtaatttgatggaaagacctactgtgaagtgggtgttctgaattatgagagttatatgaataggaaggaatggcatctaatggtatcaccccttaaatatttctgtcaaatcataacctagaagttatctcttactcttctttcatgtttcatatctaatcatccactaagttccccgagtccaccttttcattagcatgcaaattaattcctatcctaccctatgtttccttcaattttagacctttattatttctaacctagactttgtaacctctttactcccagtctttcccaatcatctatcccttcattacactactgccagagtgatctttctgaaataacaactattgctcctttgttaacataccttcattgactccctctcaccagctgtataaagtccactctcctcacccgcatcccgtttttcacacttgggcacaccctgctccagctctgtgttctagctgggttgccatgcttacagtttaccaaggtgctgtgctttaccagtgcctcagtactgcagtgtcagtgcagggccattgcgtcttctggtttctctacaggacactctccatctaaatggcttcacagtgtggaaaactccagctcttctttacattcagtttaggcattggatcacttggaaaaccattccacacactttcttgcagttagggacttaccttccctgtttcctgagaagctttgtatacttctgccacagtacttatcacattatactgtagctactagtgacccccactagagtgtaaagctcgttgcatctctagcatgtagctcagtggctggctctttgttatttgttgaaatgtatatttttaacaaatttgatactcatgaagttctgtgtttctgagataattttatagttacacagctgttttctgggacagttactttaaaatttcctggttttttcttttgcatattggaactaagcaatgactggatataaagtatcactatacacatatttgatgtcaccactaaagtttgaccaatgtttaatggtttttcaggaataaaaataaagtcctatgaattaggatataaattgtgtttatgttgccactgcttaccatttctttgttagatgttatgcctagattaatgtcattagcttatatgctgaaaatgtaatcacataatgtttttaaaatagtaaatgacacaattattatatatatgtaaaattcagatccattcaaaaaatatccatgttcttttatatgcttaggactcaacttggtgctattgtatttagctattgtaaaatagctcagcctttaagaagtttgtatataaggtaagacctgcttatataacagccaatttaagattaaaaatagcagtctaagctgagtatagtggcacatgcctatagtcccagctactcaggaggctaaggcaggaggattgcttgagctaagagtttaaggctacagtgagctgtgattgtaactgagaatagccactgtactccagcctgggtaacacagagagaccatgcctcagtgtaaa

SEQ ID NO: 81537 - DNA, 807 bp, Homo sapiens
aaagaatttgatacaatttagcattgattccaaattttttaaaaccagtaacaaaggagaatagtatccttaacaggataaaattatctatgtcatgtcaacagaaggaatcatactgaattgtgaaatattggaatcatctcccctaagatcaggaagaaaacaaagatggctgctatcaccattattatttaatgttcttctagaagttttggacaatgtcatattatatgacttagaaataagaattataactatctgaaaggaagaaatgaaattatcactatttggaaatgatagaattatctacctagacaaaaggtttaattaaaaaacatttggaattaataagaaaatttagcagaagatctagttaaaagataaacatcccaaagccaaaaattgtgttatataatcatctccaataagaagctgtgacagaaaaaagatctcattcaggagagcaataaaaaacagaatatctagaaataaccttaaaataatttgacagtaatttgatggaaagacctactgtgaagtgggtgttctgaattatgagagttatatgaataggaaggaatggcatctaatggtatcaccccttaaatatttctgtcaaatcataacctagaagttatctcttactcttctttcatgtttcatatctaatcatccactaagttccccgagtccaccttttcattagcatgcaaattaattcctatcctaccctatgtttccttcaattttacccctgggtttttccaagcaacaacgttgtaaactgatcgactacgcagtctgtcc

SEQ ID NO: 81538 - DNA, 747 bp, Homo sapiens
ataaaacattatgaaggcaaaaaaaatgttaaataaagttattatatcaacaggtaatttacagcacagttcaatatttatacactgtaaatatatttttatagttcttttggaccctttgtatattctgtgttatacatactcacatacaaacacacacataccaggaaaggagagaggaaatacagaagtagccacgtgttagttaattatttgatgctgcatcttcgattactaatgagcccagtgacaacactttgttgatttttatgtgaaaattctttatgatcatcagtgttatgaagtggtttccacgaaagcatttcacccatctttttcttcttttaaagaaacatttacaatagtgatgctgtttaagttttgttaatacaatgcatttttgttgggggaagcattcttcggaaaaaccgtatcagcttttgctttcacatctagcataaatgtataagactgtaagaagaggcaatataaaaatgtaatatgcatgatcctttctttctggcatcaccgacctcattaatagatttgtgtgtaagggaatatagtcctgaaaattgttaaaccagatctcaaccctggtttttacactgatgtgagtatcctgtgccagacactttatttcaacaggccttagttttctcatttataaataagagcctgccctggaatgatcaggaacatccttctgggagtaattccctgtgactctgtgccctgttagggcca

SEQ ID NO: 81539 - DNA, 2466 bp, Homo sapiens
gtcacagccccgagtggaagggaaaaaaaaagaggaggcggcggaggaggcaagagccgacgcgaggggaggggagcgcagcggcggggctaacgggcgggcaagcgggcgggcggcaacagcatgtccctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacggagtcctttcctttcccgggacgctgggccatgagctccgcggcccacctgaggcacaggggagtctgctcggccaggacagcctccccgaagtcccgtgccctcgcctctgcactgcgggacgccagcgctcggccctggcggaggcgtcttcggaagagcatcggggtgggggcatggaatccgcggaacctgcgggccaggcccgggcggcggccaccaagctgtcggaggctgtgggcgcggcgctgcaggagccccggcggcagaggcgcctggtgcttgttatcgtgtgcgtggcgctgttactggacaacatgctgtacatggtcatcgtgcccatagtgcccgactacatcgcccacatgcgcgggggcggcgagggccccacccggactcccgaggtgtgggagcccaccctgccgctgcccactccggccaatgccagcgcctacacggccaacacctcggcgtccccgacagctgcgtggccagcgggctcagcccttcggccccgctaccctacggagagcgaagacgtgaagatcggggtgctgtttgcttccaaggctatcctgcagctgctagtgaaccccttgagcgggcccttcatcgaccgcatgagctacgacgtgccgctgctgatcggcctgggcgtcatgttcgcctctacagtcctgttcgccttcgccgaggactacgccacgctgttcgcggcgcgcagcctgcagggcctgggctcagccttcgccgacacgtctggcatagccatgatcgccgataagtacccggaggagccggagcgcagtcgtgcactgggcgtggcgctggccttcattagcttcggaagcctagtggccccgcccttcgggggcatcctctatgagttcgccggcaagcgcgtgcccttcttggtgctagctgccgtgtcgctctttgacgcgctgttgctgctggcagtggccaaacccttctcggcggctgcacgggctcgggccaacctgccagtgggcactcccatccaccgcctcatgctagacccctacattgccgtggtggccggcgcgctcaccacctgtaacattcccctcgccttcctcgaacccaccattgccacgtggatgaagcatacgatggcggcttccgagtgggagatgggcatggcctggctgccggccttcgtgcctcatgtgctgggcgtctacctcaccgtgcgcctggcggcgcgctacccacacctgcagtggctgtacggcgcgcttgggctggctgtgatcggcgccagctcgtgcatcgtgcccgcctgccgctccttcgcgccgctagtggtctcactatgcggcctctgttttggcatagccctagtcgacacagcactgctgcccacgctcgccttcctggtggacgtgcgccatgtctcagtctatggcagcgtctacgccatcgccgacatctcctattcggtggcctacgcgctcgggcccatagtggcaggccacattgtgcactcgctgggctttgagcagctcagccttggcatgggactggccaacctgctctatgctcccgtcttgctgctgctccgcaacgtgggcctcctgacgcgctcccgttccgagcgcgatgtgctgcttgatgagccaccgcaaggtctgtacgatgcggtgcgcctgcgtgagcgtcctgtgtctggccaggacggcgagcctcgcagcccgcctggcccttttgatgagtgcgaggacgactacaactactactacacccgcagctagcatccccactcctcctccagcccacccaaccgccttgggtcaagggggctgctctgcaagcccactggccagctctggctcagggcccacctcctccagcgagtaccccagccactcctcaaccttgacttctgcccaaatcccctccctgtgacccgttccatatccctttctctcttgtccaatggggcttggagcaccgaggccagcgaagccatcgcgctccttgcggaggtgaagaggaccctgagtccccacctgcggctcccctgtgtagagcctgcatctgtctgtccttccttccattgctcccagtgccaaacttgggccgctgcaccgcggcgcctccgcccaaatcaataaactgtgtctgtcccaggaggc

SEQ ID NO: 81540 - DNA, 743 bp, Homo sapiens
tttctctttatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgagtaagtgatcaaaatactcccaagttattttttaacctccatctgcagacctaccttattcagatacattttgagattcatggtagtgcctttctggcataaggaggtgtatgatttagattgcttttagaattttcatgtttatcacatgcttgggactttatttctgtaatacataactttttgtttttatttttcacatgtcatttgaaaaattctcttgctcgtaactatattttcctttttgtaatttttacgacagttacttttgctaggaacttttaaaatataaaaacttttaagatttttttaaatgtaccctcattatt

SEQ ID NO: 81541 - DNA, 2849 bp, Homo sapiens
tttctctttatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaatgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatcca

SEQ ID NO: 81542 - DNA, 2994 bp, Homo sapiens
agacatctgaatttatgacttctaatattagttggttttaaaatgcaattgccaccatcagtgccttcccttccagctgagacatctgaatttatgacctttacaatcctttatctatatgatctcagaaacatggattttcatcttcagaaacaggagcaaagctggattgaaaataagatcatctatttatttttaattacaaagacatcccgtcattaaaatgggcatctatttgtttaaatatagtttgtcccctttgccagttaacgctgtttcaaaaactgaaatagtgccaacagtattttctcctttgagttttatgtctacatttggactaattcagggtcacttagccctttttgtcatattctacttgctatttataatagatttgttcataaactgtgttgtacaaaaataaggcattgtccttaattacaggagttttcctttgctaatatatatttattatttgaaaaacttaaacgtttcaaagaaaaagaaaatgcttttaaaaaattattttgttatatatggcttatatctcaacatttcattttgattatttgctttttaaactcatgacactgttttattttttttcattgtcctgcaatttcagagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaatgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatcca

SEQ ID NO: 81543 - DNA, 2453 bp, Homo sapiens
ggacgcgtgggtcgacccacgcgtcgaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaatgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatcca

SEQ ID NO: 81544 - DNA, 2938 bp, Homo sapiens
  misc_feature (2865)..(2865): n is a, c, g, or t
  misc_feature (2874)..(2874): n is a, c, g, or t
tttctctttatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaatgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccaaaaaaaaaaaaaaaanaaaaaaaanaaattttggggcggcccggcccccggaaaaggtttttaaaccccctggggggggggggggcccc

SEQ ID NO: 81545 - DNA, 1547 bp, Homo sapiens
ggacgcgtgggtcgacccacgcgtcggtattatttaatgtcactattggttagtggccatttttcagaactgaagatggaatggcctgaccagctattaagaatgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatcca

SEQ ID NO: 81546 - DNA, 2148 bp, Homo sapiens
tttctctttatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaatgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgta

SEQ ID NO: 81547 - DNA, 1105 bp, Homo sapiens
  misc_feature (1064)..(1064): n is a, c, g, or t
  misc_feature (1094)..(1094): n is a, c, g, or t
tttctctttatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacgctattgtacaggggnatacgctgctacagcacatgccggtaccgngctcgaatgta

SEQ ID NO: 81548 - DNA, 267 bp, Homo sapiens
gtaagtatgtggatccagtggtcaactgaaaataaaatggagagggacctactgccctgcagttggttgttaccatggagacagtttcaagagctgcagcaggttgctaattgtcttcaagggcaacttaacagttataaattaatttgtatgccgatcttaactttttctggcaccttaggaattcttaatttaaagcaaacattatttttcagttatatgtttataacttgaacatataaatatgtataaatgcagttatttgaa

SEQ ID NO: 81549 - DNA, 481 bp, Homo sapiens
ggaggatcacttgagccccaggagttcaagaccagcctggtcaacagaacaagaccccgtcccttaaattttaaaaaaagggaacggcgggggagctctatttttcaccattttgagaaataactgatccgtgaaaactaggaactgtattttcattcctttttaaatataacatttgtttgaaaatggcaaattaattatgcatattcagccatttcatttcctatctaaagtttgctgagagaaatgacaagtttactaaaagtgaacaaggatcgaaacagatcatgatttagactgtggacctgtaggaaaagtacctttgatattattgagaatatttggctcacttgttttttttctttgttccctttattttagggcaaacactgtatccttgatgtgtctggaaatgccataaagagattacagattgcacagctttaccctatctccatttttattaaacccaaatccatgg

SEQ ID NO: 81550 - DNA, 2783 bp, Homo sapiens
tttctctttatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggagatccctgacgacatgggatcaaaaggcctgaagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaatgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatcca

SEQ ID NO: 81551 - DNA, 3217 bp, Homo sapiens
tttctctttatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaatgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccacatgttaagtgtgtcttgaattttgaaagaaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctgga

SEQ ID NO: 81552 - DNA, 2743 bp, Homo sapiens
tttctctttatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaatgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcctattttgttataataaaatatatataaatatatatataaaactttctttaaactgtaactatgggaattattttctttacatagttgcgcacacacacaaacatatatatatatttaaaatatattttgtttcttttgccacctactcctaactttttgtttggtttttaaattaaatattaattgaatagacttatcttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctc

SEQ ID NO: 81553 - DNA, 2015 bp, Homo sapiens
  misc_feature (1942)..(1942): n is a, c, g, or t
  misc_feature (1951)..(1951): n is a, c, g, or t
tttctctttatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaatgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacaaaaaaaaaaaaaaaanaaaaaaaanaaattttggggcggcccggcccccggaaaaggtttttaaaccccctggggggggggggggcccc

SEQ ID NO: 81554 - DNA, 441 bp, Homo sapiens
tttctctttatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaaggggtgagtatttgaaatctctacatttttgtaattcctgtttgagctacattgttaaaatgaa

SEQ ID NO: 81555 - DNA, 792 bp, Homo sapiens
ttggagaaagagcctctctgtgtctcccaggctggactgcagtggtgtgatctcagctcactgcaacctcagccttccaagtagctgggattgcagacatgtacccccataccagctatatatatatatgtattttagacacagtttcaccatgttagccaggccattcttgaatcctgacctcaggtgatttgccgacgtaggcctcccgaagtgctgggattacaggtatgagccactgcactcagccttttttcctaattttgaatatgggacccattatgaatttgggtgtcacctatgtgcgggggctatggaaatctctgtcaccccattcatttgtgtgtgctgtcaaagcaccaatatgtgggaattatgctttatgtgagcatatagtatatggaactttggtttttttttatacagggtctcaaaaaaaaatgagtatatttcatcacaatgttctgtgtataattccatacacacaaaatagtcttctatacacagagaacactcttatatcactttggagttgtttttgtttgtgtattttgttttaatttttatgagacagggcctggctatgtcgctgaggctggagggcagtggtgagatcttggctcactgcaacctccacctgccacctcagcctcctggattagtgtctacaggcaggcaccaccacccctgggtaagttctgtatttttggtactgatgaggtttcagcacgttccacaggctggactcttaactcctgcgatcaagtgatcctcccgctgttcaaattttac

SEQ ID NO: 81556 - DNA, 539 bp, Homo sapiens
atgagaactgatgttttgagaggtttctagaaggtgaattcactttcgttcagaaattagagatgcagatgatgcacaagcaagaattttaaataatattttgtatttttactgcaatgtattttaacttatatatgtggttaactcctttctcatgctcagttttttttgtttatttgttttgcttttatttactctgtgcctgaattttcattgagcacttgctaaggaactgttgtgagccaatattattcttgctctcatgtatgtagcaagaagccttaagaaagatttattagaaaaaaaaatgactatagaaatacaaggcatgatttgtgtttatggtgagaaattgaaaaggaaaagatgcagggtatatttctaaggattctacaaccctatctgatcaggctgatagctctgaccttccatttgtacagagtaagaaggtttctaattgtttgcagatcacttagcaattgatggtgccattttccttgggcagcccatttgccaatcgatattttctggcagagtca

SEQ ID NO: 81557 - DNA, 160 bp, Homo sapiens
gatatctacaaacatgcaggtctctaatcataggagcctggaatgagtcctagaatggaccctttaagtgacttgagagagagaaaatgattctgtctaggtttttttttttgtccccttctctttgctatgataaaattcgtaaccttaagccatatag

SEQ ID NO: 81558 - DNA, 313 bp, Homo sapiens
ccctaaaaggcagagtgtcttcttacctccacacaaccacgctagctctatagcagtggttcttaaccagattgaaatggctgaaatgacagacatatatttcagaacctggatgggaagaaagctcaatgagatagaggagaaggttgaaacgcatccaagtaaagcagtaaaatgatccaagagttgaaagatgacttagccattttaagaaagaaccaaacagaacttctggaaataaaaaaaaatcactacaggaatttcataatgcaattggaagcataaataacaaaataaaccaatctgagggaaa

SEQ ID NO: 81559 - DNA, 2672 bp, Homo sapiens
gaggagaggcagggaggggcggcgggggcgcactgaacatttaggaagcaagatgtctagcaggctgggccttgagagaacagtaactgtttcgcaactgaaagtcgctactcgagccttgccaactggggagactatgcccatgatatccgcggcctcggaccccggaccctccaggccctcgcgccccacccccgaccagcctcgggccaggctagggcgtagacggggcttcccgtccctcacgcgggcccgccccatgccgggcggggcctggggcccgccacctccgcccgtggccggagagccccaggcccgagccacgcggtcttccgggcccgggtcggggctcgatggctacgtggaggcgggacggccgactgacaggcggccaaaggctgctgtgcgctgggctggcggggacgctcagcctcagcctcaccgcgcccctggagctcgccaccgtgctggcccaggttggccgccgtgcagctcgccgcctaccgcaaatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggctcagagcccctacctcccacacagtggaggagtagatgtccatttctcaggagcagtggactgcttccggcagatagtgaaggcccagggggtcctggggctctggaatggattgacagccaatttactgaagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctgagtggataccacgttgtgaggtcagccactgggtcacttgtagtcaatgcaaagcttgcacaaaccaacgtcagcctagtttcactcagtttgacctgagactttccaatacaatctgttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaatttttgggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtttcagaaagacagtttataccatgactgcttaattatccccccaaagaccttctgattgaagtcatgtacagttcagtggcctaaattctctgcctttttaacttgctttgcaagcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactatacttgtcaaatagcacctatctatgcatttaaaaatgcattaatatctaacataaaattgttaatttatacacacacatacacttatacatagagagagattttcggtatgttgcaagtattttttccgattaaatttattttccaaagaaaaa

SEQ ID NO: 81560 - DNA, 1968 bp, Homo sapiens
acccttcctgttggtaaatagtagaaaaagcatggaggagccccctgtacgatggttccagtatgttctgcatgatcaaccccacagcagccattctttgccatcatcttggccaggaacccagcatccagaatgtagacttgagaccctggctccttccactaggacatttatttcctaatgtttcaatcacctcatcccagcttctgtttcctgtcaggctcagagcccctacctcccacacagtggaggagtagatgtccatttctcaggagcagtggactgcttccggcagatagtgaaggcccagggggtcctggggctctggaatggattgacagccaatttactgaagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctgagtggataccacgttgtgaggtcagccactgggtcacttgtagtcaatgcaaagcttgcacaaaccaacgtcagcctagtttcactcagtttgacctgagactttccaatacaatctgttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaatttttgggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtttcagaaagacagtttataccatgactgcttaattatccccccaaagaccttctgattgaagtcatgtacagttcagtggcctaaattctctgcctttttaacttgctttgcaagcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactatacttgtcaaatagcacctatctatgcatttaaaaatgcattaatatctaacataaaattgttaatttatacacacacatacacttatacatagagagagattttcggtatgttgcaagtattttttccgattaaatttattttccaaagaaaaa

SEQ ID NO: 81561 - DNA, 2791 bp, Homo sapiens
gaggagaggcagggaggggcggcgggggcgcactgaacatttaggaagcaagatgtctagcaggctgggccttgagagaacagtaactgtttcgcaactgaaagtcgctactcgagccttgccaactggggagactatgcccatgatatccgcggcctcggaccccggaccctccaggccctcgcgccccacccccgaccagcctcgggccaggctagggcgtagacggggcttcccgtccctcacgcgggcccgccccatgccgggcggggcctggggcccgccacctccgcccgtggccggagagccccaggcccgagccacgcggtcttccgggcccgggtcggggctcgatggctacgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaaatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggctcagagcccctacctcccacacagtggaggagtagatgtccatttctcaggagcagtggactgcttccggcagatagtgaaggcccagggggtcctggggctctggaatggattgacagccaatttactgaagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctgagtggataccacgttgtgaggtcagccactgggtcacttgtagtcaatgcaaagcttgcacaaaccaacgtcagcctagtttcactcagtttgacctgagactttccaatacaatctgttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaatttttgggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtttcagaaagacagtttataccatgactgcttaattatccccccaaagaccttctgattgaagtcatgtacagttcagtggcctaaattctctgcctttttaacttgctttgcaagcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactatacttgtcaaatagcacctatctatgcatttaaaaatgcattaatatctaacataaaattgttaatttatacacacacatacacttatacatagagagagattttcggtatgttgcaagtattttttccgattaaatttattttccaaagaaaaa

SEQ ID NO: 81562 - DNA, 2618 bp, Homo sapiens
gaggagaggcagggaggggcggcgggggcgcactgaacatttaggaagcaagatgtctagcaggctgggccttgagagaacagtaactgtttcgcaactgaaagtcgctactcgagccttgccaactggggagactatgcccatgatatccgcggcctcggaccccggaccctccaggccctcgcgccccacccccgaccagcctcgggccaggctagggcgtagacggggcttcccgtccctcacgcgggcccgccccatgccgggcggggcctggggcccgccacctccgcccgtggccggagagccccaggcccgagccacgcggtcttccgggcccgggtcggggctcgatggctacgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaaatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggctcagagcccctacctcccacacagtggaggagtagatgtccatttctcaggagcagtggactgcttccggcagatagtgaaggcccagggggtcctggggctctggaatggattgacagccaatttactgaagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctgagtggataccacgttgtgaggtcagccactgggtcacttgtagtcaatgcaaagcttgcacaaaccaacgtcagcctagtttcactcagtttgacctgagactttccaatacaatctgttgttttgttttgtttttagagacagggtcttgctctgtcacccagactggagtacaatgacacaatcatagctcactgcagcctttaactactgggctcaagacatcctcctgcttcagcctccagagagttgggaccataggtgcacaccaccacacctagctaatttttgggggaggtcttgctatgttgcccaggctggtcttgaactcctgggctcatgcaatcctcctgccttggcctcccaaagcgctaggattagaggtgtgagccgctgcaccctgccccagtacaatcttttttgaactcaaatttttgctgacatctgagtgcacacaccacagtgtaaattatgccttatcagaatctaaatgaaaatagcgaacatttaaaagctatcaccattgtagtagaatcatccttcttttttgaaatttgaagcatcccaggcttaaaatcttgtgtttcagaaagacagtttataccatgactgcttaattatccccccaaagaccttctgattgaagtcatgtacagttcagtggcctaaattctctgcctttttaacttgctttgcaagcctactctgaaaataagttatttagtcaagttattctcaaagatgtcccagttgcctagaaaggatcaaatggaacatttgacacacatactcaaaaaaatgtaactgactataaacactttaacctaatcatctgtatcaaactttctaaaaatcaaatctcaggattgttccactttagagattctatgtaaagtttatataactatacttgtcaaatagcacctatctatgcatttaaaaatgcattaatatctaacataaaattgttaatttatacacacacatacacttatacatagagagagattttcggtatgttgcaagtattttttccgattaaatttattttccaaagaaaaa

SEQ ID NO: 81563 - DNA, 862 bp, Homo sapiens
acccttcctgttggtaaatagtagaaaaagcatggaggagccccctgtacgatggttccagtatgttctgcatgatcaaccccacagcagccattctttgccatcatcttggccaggaacccagcatccagaatgtagacttgagaccctggctccttccactaggacatttatttcctaatgtttcaatcacctcatcccagcttctgtttcctgtcaggctcagagcccctacctcccacacagtggaggagtagatgtccatttctcaggagcagtggactgcttccggcagatagtgaaggcccagggggtcctggggctctggaatggattgacagccaatttactgaaggtgagaagagccaccagcctccgctgctcccctgcctcttccaattctaccctcttcctttgtcacccccaacccctactacagtttgcttggaaaaccccctctagcactaatgggtagcacaaggcccatgaatgcacactgtctgtcagccccgtagagaggggaacctgtgcagtggtggagtatcttataccccattccagaggagctgagcatttagtgcagagatacttaatgtggaggttcatgggcccctaatgggaacctaacccctcatcctaaaattctatgcaaaaatgtatgtgtatatgcatatgtgcatcatattcccaaagaactccatgacaaaaaaaaaaaacaaaaacaaaaaacattaagcactctggactaaccttgcactagctggcatgtaaatgattccagtcaaggccagcatatagtgacaggtagtatcagatagtctgcgtgcatatgacccagatctagtgcctcccaggcaggtca

SEQ ID NO: 81564 - DNA, 1685 bp, Homo sapiens
gaggagaggcagggaggggcggcgggggcgcactgaacatttaggaagcaagatgtctagcaggctgggccttgagagaacagtaactgtttcgcaactgaaagtcgctactcgagccttgccaactggggagactatgcccatgatatccgcggcctcggaccccggaccctccaggccctcgcgccccacccccgaccagcctcgggccaggctagggcgtagacggggcttcccgtccctcacgcgggcccgccccatgccgggcggggcctggggcccgccacctccgcccgtggccggagagccccaggcccgagccacgcggtcttccgggcccgggtcggggctcgatggctacgtggaggcgggacggccgactgacaggcggccaaaggctgctgtgcgctgggctggcggggacgctcagcctcagcctcaccgcgcccctggagctcgccaccgtgctggcccaggttggcgtcgtgcgaggccacgcccggggaccgtgggccacagggcaccgggtgtggcgggcagaggggctccgggccctgtggaaggggaacgcggtggcgtgcctgcgcctcttcccctgcagcgccgtgcagctcgccgcctaccgcaaatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtaggtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggctcagagcccctacctcccacacagtggaggagtagatgtccatttctcaggagcagtggactgcttccggcagatagtgaaggcccagggggtcctggggctctggaatggattgacagccaatttactgaaggtgagaagagccaccagcctccgctgctcccctgcctcttccaattctaccctcttcctttgtcacccccaacccctactacagtttgcttggaaaaccccctctagcactaatgggtagcacaaggcccatgaatgcacactgtctgtcagccccgtagagaggggaacctgtgcagtggtggagtatcttataccccattccagaggagctgagcatttagtgcagagatacttaatgtggaggttcatgggcccctaatgggaacctaacccctcatcctaaaattctatgcaaaaatgtatgtgtatatgcatatgtgcatcatattcccaaagaactccatgacaaaaaaaaaaaacaaaaacaaaaaacattaagcactctggactaaccttgcactagctggcatgtaaatgattccagtcaaggccagcatatagtgacaggtagtatcagatagtctgcgtgcatatgacccagatctagtgcctcccaggcaggtca

SEQ ID NO: 81565 - DNA, 433 bp, Homo sapiens
gggagatgcattaaatacttaaaagattgctgaagtccggtagttttgaagaattaaccatctcttcgaatgttgaaacgtggaaaagaattttggcacttctggaccctgatgaaaagtaaataacttatacatacgtggaacttgtaatttactggtgacaggccattcaatccagcagtaataatttctgttttcagctacagccattgaatagtacaaattaggctcttttttctttcaataatgtttttgtaaagctcactgggcttttagaaagggaaattttaggtatgtttctcactggttaagcagatttcttggattcattcatggagtgtgctgttttccaactttatggtcacacaagtctaggaagcataaatgtgaacagaaagctgactctatgtgtgcgtatgtgtatgcaggtgac

SEQ ID NO: 81566 - DNA, 294 bp, Homo sapiens
ggggattgtattggttaaccacacacgctgctatttcagtttaatcttgactgaacttcttggctactgcaggctttcttacaccactagagttcttgctcattacagtgttgaatccctatcaaaacctttcctgtttaattggcagtgacacaatcccatcttgtgtaactcaggatgtttcacatcctgaaatagtttgaaataaaattgaaacacacttacattgatgcctatgttaatttctttccttgactgtgtctgaatataatgttgaagtgtgatagaaacaat

SEQ ID NO: 81567 - DNA, 733 bp, Homo sapiens
ataattgtaacaagaacatattcactagcaatctgagcactcatgatattaatgtctgttctggagagaattatgtccccccagaattcctaacctgaagccctatctcccagtgtgactgtatttggagaaggagcttttaagaagttaaaggttaaataggggcaaaagggtaaggccctaatctgttaggactggggtcatcatccaaaaaggaagagacaccagagatacatatctctctcttctctctctctctgcctccctccttctctctctctccctctctccctctccccacatacatttgttaaattgaggttttttgttagaacatatatagtggcattttaatatagtattactctacttaaaacatacacacacacacacacacacacacacaattttgataaattcttttttgaggataaggccgggcatggtggttcacacctgtaatcccagcacttggcgggattatcatatgaggtgggtggatcatctgaggtcagaggttcaagaccagcctggccaacatggtgaaacccttctctattaaaaatacaaaaaattagctgggcgtggtggcgggcacctgtaattccatttactcagaatgctgaagcaggagagtcccttgaacccaggaggcggaggttgtggtgagccgagattgcaccattgcactccagcctgggcagcaagagcaaaactccgtctcaagaaaaat

SEQ ID NO: 81568 - DNA, 472 bp, Homo sapiens
caaaattattgtggcaagattttaaaagtacaaagttaccacaaagataaccttttgaaacagaatatttcctaaaatagtccttgatattctgaataggagtaaaaattgataatgtatcagaaggatttagtctggctaacctcaaaacccatattctcagggctagctcgctgagtgaaactgactaggagtactacatagactgtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtacagtatcatcctgtcatctacac

SEQ ID NO: 81569 - DNA, 5364 bp, Homo sapiens
gggcggccgctcgcgatctagaactgaaaagaaaaagccaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatcctagccctgtgcactcagcactcataggatcatccagactctcatgctggcatgcagtctaatcatgacaaataatgctgctactctgatatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcattttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtagcatcacttgtctcccgtctcattttttccttgcatgtcacaagtctcagatcatttataatacattaacagtaaataatatctatgtaaatttctttcaccatgctgtctcagagtcagcagtgaacaaaggcaaagattggggccccacttagtttgaaaaagggaaaggaagtgatctaggatgtgtactagaagcatttcaaatgttgggtctttaaaatgttttgttcagtcttagcaaatcttcgatcttttatttcaaaattccagtagtccactgtggagcccatgcatttcatctggaatttaatgttactttgaagccaaaccatttaaacaattatgtgtgttttattagctagtgttgctgaaaatgcacttagttcaattttaattgtaaatgggaattttaaacttttcctagttagcatggttatatgttagttaaaactgaaagctaaattgaagatattacattttaatttatggtgacagataagggtttgtatgcattatgtgtaaatcagcttcatgctgtttaaaaatttattctctgaaatttatagaccatgtagaattgatttgtgatgtgatgctttaatttattgcaagaaaattagtatggcttcaaactgccacaggtaggcatgtaacaatggctgttcagctgtactgatccaaaatggagaaaactgatgatacaagggccaaacatcttatgaaatgcaactatttatagacttgttttgctatagggaggctggtgaacacgctgaatacgaattacctcagttctgcagctttctatgtctttttaatgcattctgtttcagggtcactttcaatcaatatttcatttacttactgagattgaatgggcgctctgagacacagtgtgctgtttatcatacagattggacacctcattctagatccaagatcttttcctcaacactgggagctgtcctttcagcaccacaaaattactgcttgaagttgcattgcagtttttttgttttttttttgtttgtttgtttgtttgtttttttgtttttttctttatcactgggagcttttctttcagcaccacaacattgcacctagactttttaaacggctgccttcctctttgcactgaagaccaatttcgtctgcacttccagttattgctattacctgtaggactttcaatcctacttcacttcacccaccccactcctgaaacagttaaatgtatctatttctgtggaagtcattttctcattgaatgattagaaacaaagataaattctaacctgtaacggctcatttcgactcattgcttacaatagatctaagctcttttttctgcttattcgactccttccagcttcccatcacatctgtaacaaacttttaaaatgatattgccacaccaccatgcacaagcctacctgcacagtagagatagattattccatcgcattcagatggttaacagaggttagcaagtcctgtattatatatttatatcgctttctaagaaagtgcatattaatgtttactttaagaatgtgtaaatggtgctatcaagaatctgataaattttatccccgttttttgtgtaccacttctaatgtatgagatttatttttttattggaaaaaaataaacagtatgaaagcatt

SEQ ID NO: 81570 - DNA, 5683 bp, Homo sapiens
gggcggccgctcgcgatctagaactgaaaagaaaaagccaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatcctagccctgtgcactcagcactcataggatcatccagactctcatgctggcatgcagtctaatcatgacaaataatgctgctactctgatatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcattttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtagcatcacttgtctcccgtctcattttttccttgcatgtcacaagtctcagatcatttataatacattaacagtaaataatatctatgtaaatttctttcaccatgctgtctcagagtcagcagtgaacaaaggcaaagattggggccccacttagtttgaaaaagggaaaggaagtgatctaggatgtgtactagaagcatttcaaatgttgggtctttaaaatgttttgttcagtcttagcaaatcttcgatcttttatttcaaaattccagtagtccactgtggagcccatgcatttcatctggaatttaatgttactttgaagccaaaccatttaaacaattatgtgtgttttattagctagtgttgctgaaaatgcacttagttcaattttaattgtaaatgggaattttaaacttttcctagttagcatggttatatgttagttaaaactgaaagctaaattgaagatattacattttaatttatggtgacagataagggtttgtatgcattatgtgtaaatcagcttcatgctgtttaaaaatttattctctgaaatttatagaccatgtagaattgatttgtgatgtgatgctttaatttattgcaagaaaattagtatggcttcaaactgccacaggtaggcatgtaacaatggctgttcagctgtactgatccaaaatggagaaaactgatgatacaagggccaaacatcttatgaaatgcaactatttatagacttgttttgctatagggaggctggtgaacacgctgaatacgaattacctcagttctgcagctttctatgtctttttaatgcattctgtttcagggtcactttcaatcaatatttcatttacttactgagattgaatgggcgctctgagacacagtgtgctgtttatcatacagattggacacctcattctagatccaagatcttttcctcaacactgggagctgtcctttcagcaccacaaaattactgcttgaagttgcattgcagtttttttgttttttttttgtttgtttgtttgtttgtttttttgtttttttctttatcactgggagcttttctttcagcaccacaacattgcacctagactttttaaacggctgccttcctctttgcactgaagaccaatttcgtctgcacttccagttattgctattacctgtaggactttcaatcctacttcacttcacccaccccactcctgaaacagttaaatgtatctatttctgtggaagtcattttctcattgaatgattagaaacaaagataaattctaacctgtaacggctcatttcgactcattgcttacaatagatctaagctcttttttctgcttattcgactccttccagcttcccatcacatctgtaacaaacttttaaaatgatattgccacaccaccatgcacaagcctacctgcacagtagagatagattattccatcgcattcagatggttaacagaggttagcaagtcctgtattatatatttatatcgctttctaagaaagtgcatattaatgtttactttaagaatgtgtaaatggtgctatcaagaatctgataaattttatccccgttttttgtgtaccacttctaatgtatgagatttatttttttattggaaaaaaataaacagtatgaaagcattaaattggtagattttagtaatttaacaatgaatggaatccctacgttacaggccctatgtttccttggaaattttaatggtggtaatagatttcaacaaaggtactgataatcatattccttttaatccattcttatatttcagtcttgatttatatgctgattcctcactgagtccttaagtaaagtttatttacttaataattttatttactgtaagtcttctccaagaagggaattcttgctttcgaaggcagcaattgagagatgaaaatataatttaataccccttacatcacaggcactatttgagactagtt

SEQ ID NO: 81571 - DNA, 5268 bp, Homo sapiens
gggcggccgctcgcgatctagaactgaaaagaaaaagccaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaagtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatcctagccctgtgcacctctcatgctggcatgcagtctaatcatgacaaataatgctgctactctgatatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcattttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtagcatcacttgtctcccgtctcattttttccttgcatgtcacaagtctcagatcatttataatacattaacagtaaataatatctatgtaaatttctttcaccatgctgtctcagagtcagcagtgaacaaaggcaaagattggggccccacttagtttgaaaaagggaaaggaagtgatctaggatgtgtactagaagcatttcaaatgttgggtctttaaaatgttttgttcagtcttagcaaatcttcgatcttttatttcaaaattccagtagtccactgtggagcccatgcatttcatctggaatttaatgttactttgaagccaaaccatttaaacaattatgtgtgttttattagctagtgttgctgaaaatgcacttagttcaattttaattgtaaatgggaattttaaacttttcctagttagcatggttatatgttagttaaaactgaaagctaaattgaagatattacattttaatttatggtgacagataagggtttgtatgcattatgtgtaaatcagcttcatgctgtttaaaaatttattctctgaaatttatagaccatgtagaattgatttgtgatgtgatgctttaatttattgcaagaaaattagtatggcttcaaactgccacaggtaggcatgtaacaatggctgttcagctgtactgatccaaaatggagaaaactgatgatacaagggccaaacatcttatgaaatgcaactatttatagacttgttttgctatagggaggctggtgaacacgctgaatacgaattacctcagttctgcagctttctatgtctttttaatgcattctgtttcagggtcactttcaatcaatatttcatttacttactgagattgaatgggcgctctgagacacagtgtgctgtttatcatacagattggacacctcattctagatccaagatcttttcctcaacactgggagctgtcctttcagcaccacaaaattactgcttgaagttgcattgcagtttttttgttttttttttgtttgtttgtttgtttgtttttttgtttttttctttatcactgggagcttttctttcagcaccacaacattgcacctagactttttaaacggctgccttcctctttgcactgaagaccaatttcgtctgcacttccagttattgctattacctgtaggactttcaatcctacttcacttcacccaccccactcctgaaacagttaaatgtatctatttctgtggaagtcattttctcattgaatgattagaaacaaagataaattctaacctgtaacggctcatttcgactcattgcttacaatagatctaagctcttttttctgcttattcgactccttccagcttcccatcacatctgtaacaaacttttaaaatgatattgccacaccaccatgcacaagcctacctgcacagtagagatagattattccatcgcattcagatggttaacagaggttagcaagtcctgtattatatatttatatcgctttctaagaaagtgcatattaatgtttactttaagaatgtgtaaatggtgctatcaagaatctgataaattttatccccgttttttgtgtaccacttctaatgtatgagatttatttttttattggaaaaaaataaacagtatgaaagcatt

SEQ ID NO: 81572 - DNA, 5232 bp, Homo sapiens
gcaaggtgagtttctttcccacttataaaattacaatctagcggagagaaaaatgtgtgtgtgtgtgtgtagtgtgtctcagttttaacactgagcccacagttgggtggattattgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatcctagccctgtgcacctctcatgctggcatgcagtctaatcatgacaaataatgctgctactctgatatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcattttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtagcatcacttgtctcccgtctcattttttccttgcatgtcacaagtctcagatcatttataatacattaacagtaaataatatctatgtaaatttctttcaccatgctgtctcagagtcagcagtgaacaaaggcaaagattggggccccacttagtttgaaaaagggaaaggaagtgatctaggatgtgtactagaagcatttcaaatgttgggtctttaaaatgttttgttcagtcttagcaaatcttcgatcttttatttcaaaattccagtagtccactgtggagcccatgcatttcatctggaatttaatgttactttgaagccaaaccatttaaacaattatgtgtgttttattagctagtgttgctgaaaatgcacttagttcaattttaattgtaaatgggaattttaaacttttcctagttagcatggttatatgttagttaaaactgaaagctaaattgaagatattacattttaatttatggtgacagataagggtttgtatgcattatgtgtaaatcagcttcatgctgtttaaaaatttattctctgaaatttatagaccatgtagaattgatttgtgatgtgatgctttaatttattgcaagaaaattagtatggcttcaaactgccacaggtaggcatgtaacaatggctgttcagctgtactgatccaaaatggagaaaactgatgatacaagggccaaacatcttatgaaatgcaactatttatagacttgttttgctatagggaggctggtgaacacgctgaatacgaattacctcagttctgcagctttctatgtctttttaatgcattctgtttcagggtcactttcaatcaatatttcatttacttactgagattgaatgggcgctctgagacacagtgtgctgtttatcatacagattggacacctcattctagatccaagatcttttcctcaacactgggagctgtcctttcagcaccacaaaattactgcttgaagttgcattgcagtttttttgttttttttttgtttgtttgtttgtttgtttttttgtttttttctttatcactgggagcttttctttcagcaccacaacattgcacctagactttttaaacggctgccttcctctttgcactgaagaccaatttcgtctgcacttccagttattgctattacctgtaggactttcaatcctacttcacttcacccaccccactcctgaaacagttaaatgtatctatttctgtggaagtcattttctcattgaatgattagaaacaaagataaattctaacctgtaacggctcatttcgactcattgcttacaatagatctaagctcttttttctgcttattcgactccttccagcttcccatcacatctgtaacaaacttttaaaatgatattgccacaccaccatgcacaagcctacctgcacagtagagatagattattccatcgcattcagatggttaacagaggttagcaagtcctgtattatatatttatatcgctttctaagaaagtgcatattaatgtttactttaagaatgtgtaaatggtgctatcaagaatctgataaattttatccccgttttttgtgtaccacttctaatgtatgagatttatttttttattggaaaaaaataaacagtatgaaagcatt

SEQ ID NO: 81573 - DNA, 2337 bp, Homo sapiens
tgaggtgatctagaggatccctactcagacagtgaccgtgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcattttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtagcatcacttgtctcccgtctcattttttccttgcatgtcacaagtctcagatcatttataatacattaacagtaaataatatctatgtaaatttctttcaccatgctgtctcagagtcagcagtgaacaaaggcaaagattggggccccacttagtttgaaaaagggaaaggaagtgatctaggatgtgtactagaagcatttcaaatgttgggtctttaaaatgttttgttcagtcttagcaaatcttcgatcttttatttcaaaattccagtagtccactgtggagcccatgcatttcatctggaatttaatgttactttgaagccaaaccatttaaacaattatgtgtgttttattagctagtgttgctgaaaatgcacttagttcaattttaattgtaaatgggaattttaaacttttcctagttagcatggttatatgttagttaaaactgaaagctaaattgaagatattacattttaatttatggtgacagataagggtttgtatgcattatgtgtaaatcagcttcatgctgtttaaaaatttattctctgaaatttatagaccatgtagaattgatttgtgatgtgatgctttaatttattgcaagaaaattagtatggcttcaaactgccacaggtaggcatgtaacaatggctgttcagctgtactgatccaaaatggagaaaactgatgatacaagggccaaacatcttatgaaatgcaactatttatagacttgttttgctatagggaggctggtgaacacgctgaatacgaattacctcagttctgcagctttctatgtctttttaatgcattctgtttcagggtcactttcaatcaatatttcatttacttactgagattgaatgggcgctctgagacacagtgtgctgtttatcatacagattggacacctcattctagatccaagatcttttcctcaacactgggagctgtcctttcagcaccacaaaattactgcttgaagttgcattgcagtttttttgttttttttttgtttgtttgtttgtttgtttttttgtttttttctttatcactgggagcttttctttcagcaccacaacattgcacctagactttttaaacggctgccttcctctttgcactgaagaccaatttcgtctgcacttccagttattgctattacctgtaggactttcaatcctacttcacttcacccaccccactcctgaaacagttaaatgtatctatttctgtggaagtcattttctcattgaatgattagaaacaaagataaattctaacctgtaacggctcatttcgactcattgcttacaatagatctaagctcttttttctgcttattcgactccttccagcttcccatcacatctgtaacaaacttttaaaatgatattgccacaccaccatgcacaagcctacctgcacagtagagatagattattccatcgcattcagatggttaacagaggttagcaagtcctgtattatatatttatatcgctttctaagaaagtgcatattaatgtttactttaagaatgtgtaaatggtgctatcaagaatctgataaattttatccccgttttttgtgtaccacttctaatgtatgagatttatttttttattggaaaaaaataaacagtatgaaagcatt

SEQ ID NO: 81574 - DNA, 576 bp, Homo sapiens
gggcggccgctcgcgatctagaactgaaaagaaaaagccaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaagtgagtgtttagttgagaaatcaaagagaaatatccacag

SEQ ID NO: 81575 - DNA, 558 bp, Homo sapiens
  misc_feature (513)..(513): n is a, c, g, or t
gggcggccgctcgcgatctagaactgaaaagaaaaagccaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccagtgagaacaaaccagcaacattgcttttttttcctaaagagatttatatngatccgattaaaaaaaaaaacccttaagaaaccccaaacgcaaaa

SEQ ID NO: 81576 - DNA, 4865 bp, Homo sapiens
  misc_feature (4820)..(4820): n is a, c, g, or t
gggcggccgctcgcgatctagaactgaaaagaaaaagccaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatcctagccctgtgcactcagcactcataggatcatccagactctcatgctggcatgcagtctaatcatgacaaataatgctgctactctgatatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcattttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtagcatcacttgtctcccgtctcattttttccttgcatgtcacaagtctcagatcatttataatacattaacagtaaataatatctatgtaaatttctttcaccatgctgtctcagagtcagcagtgaacaaaggcaaagattggggccccacttagtttgaaaaagggaaaggaagtgatctaggatgtgtactagaagcatttcaaatgttgggtctttaaaatgttttgttcagtcttagcaaatcttcgatcttttatttcaaaattccagtagtccactgtggagcccatgcatttcatctggaatttaatgttactttgaagccaaaccatttaaacaattatgtgtgttttattagctagtgttgctgaaaatgcacttagttcaattttaattgtaaatgggaattttaaacttttcctagttagcatggttatatgttagttaaaactgaaagctaaattgaagatattacattttaatttatggtgacagataagggtttgtatgcattatgtgtaaatcagcttcatgctgtttaaaaatttattctctgaaatttatagaccatgtagaattgatttgtgatgtgatgctttaatttattgcaagaaaattagtatggcttcaaactgccacaggtaggcatgtaacaatggctgttcagctgtactgatccaaaatggagaaaactgatgatacaagggccaaacatcttatgaaatgcaactatttatagacttgttttgctatagggaggctggtgaacacgctgaatacgaattacctcagttctgcagctttctatgtctttttaatgcattctgtttcagggtcactttcaatcaatatttcatttacttactgagattgaatgggcgctctgagacacagtgtgctgtttatcatacagattggacacctcattctagatccaagatcttttcctcaacactgggagctgtcctttcagcaccacaaaattactgcttgaagttgcattgcagtttttttgttttttttttgtttgtttgtttgtttgtttttttgtttttttctttatcactgggagcttttctttcagcaccacaacattgctttttttcctaaagagatttatatngatccgattaaaaaaaaaaacccttaagaaaccccaaacgcaaaa

SEQ ID NO: 81577 - DNA, 5255 bp, Homo sapiens
aatggttgttttgcggactttaagtaggatataggcaatggctaattgtagtccttatgtgtctgctaatgacaaataaatatagctcatcactatttacagtcctgggcttttcttcttttttaatatgttaagtgaagaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatcctagccctgtgcacctctcatgctggcatgcagtctaatcatgacaaataatgctgctactctgatatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcattttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtagcatcacttgtctcccgtctcattttttccttgcatgtcacaagtctcagatcatttataatacattaacagtaaataatatctatgtaaatttctttcaccatgctgtctcagagtcagcagtgaacaaaggcaaagattggggccccacttagtttgaaaaagggaaaggaagtgatctaggatgtgtactagaagcatttcaaatgttgggtctttaaaatgttttgttcagtcttagcaaatcttcgatcttttatttcaaaattccagtagtccactgtggagcccatgcatttcatctggaatttaatgttactttgaagccaaaccatttaaacaattatgtgtgttttattagctagtgttgctgaaaatgcacttagttcaattttaattgtaaatgggaattttaaacttttcctagttagcatggttatatgttagttaaaactgaaagctaaattgaagatattacattttaatttatggtgacagataagggtttgtatgcattatgtgtaaatcagcttcatgctgtttaaaaatttattctctgaaatttatagaccatgtagaattgatttgtgatgtgatgctttaatttattgcaagaaaattagtatggcttcaaactgccacaggtaggcatgtaacaatggctgttcagctgtactgatccaaaatggagaaaactgatgatacaagggccaaacatcttatgaaatgcaactatttatagacttgttttgctatagggaggctggtgaacacgctgaatacgaattacctcagttctgcagctttctatgtctttttaatgcattctgtttcagggtcactttcaatcaatatttcatttacttactgagattgaatgggcgctctgagacacagtgtgctgtttatcatacagattggacacctcattctagatccaagatcttttcctcaacactgggagctgtcctttcagcaccacaaaattactgcttgaagttgcattgcagtttttttgttttttttttgtttgtttgtttgtttgtttttttgtttttttctttatcactgggagcttttctttcagcaccacaacattgcacctagactttttaaacggctgccttcctctttgcactgaagaccaatttcgtctgcacttccagttattgctattacctgtaggactttcaatcctacttcacttcacccaccccactcctgaaacagttaaatgtatctatttctgtggaagtcattttctcattgaatgattagaaacaaagataaattctaacctgtaacggctcatttcgactcattgcttacaatagatctaagctcttttttctgcttattcgactccttccagcttcccatcacatctgtaacaaacttttaaaatgatattgccacaccaccatgcacaagcctacctgcacagtagagatagattattccatcgcattcagatggttaacagaggttagcaagtcctgtattatatatttatatcgctttctaagaaagtgcatattaatgtttactttaagaatgtgtaaatggtgctatcaagaatctgataaattttatccccgttttttgtgtaccacttctaatgtatgagatttatttttttattggaaaaaaataaacagtatgaaagcatt

SEQ ID NO: 81578 - DNA, 997 bp, Homo sapiens
  misc_feature (988)..(992): n is a, c, g, or t
  misc_feature (994)..(994): n is a, c, g, or t
  misc_feature (997)..(997): n is a, c, g, or t
gggcggccgctcgcgatctagaactgaaaagaaaaagccaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcagaagcataatatctcctggatatcatgaagcaagatataagagaagaacaaaacaaaatccgtaattcattgaaagaattgtaatcatcaatctttcatattattaatactttgtaattattttctccccaacagtattttccagtagattctaatcatgtggtagggcagaaggaaatgtgttttttgttgttcatttgtttcttgtcaatagtcctgattattttagctttgctatactgacttatatctggaagtatataaccaagataagaaaataggttttaatatgatcatcttaagctaattgtaatgaaaagaactaatggactgtcaatattcagaaaaccaaaaataaaaaatacggaaaactaaaaaaannnnnanttn

SEQ ID NO: 81579 - DNA, 894 bp, Homo sapiens
atgagggcaactagaggttgctttcatcaccatcctggtcctagctggtttgcaccagtttctttgctatatcctgccttgattagcaggtctgtaactgaggcttggaaaacaagtcctgctgctctcccatctcgagaggatggtctgcccttaggagcgtgggctgggaaagaggcccacacaggccctggaaatgggcttcaggacactgggacatgggaacagagaatcttcaggtactgaatactcatggcctggtctagaaggggatggggtgtgctccaagaaggggtgtcccctgggtcctgcaaattccttgccccatggggaagagaaacagctggaggggctgcctaaagcacaggggcatttctaggagcaggaaagcaagaggtcatcaggtcagactggctgaaggaagactgaggtgggagctgagagcagagacttcaaccatgaccatgcctggactctccagataaagcactggtgaaatcaaagaccaacaatgtcaagtattggcaagactgtggagcaactggaactctcattccctgatggagggaatgcaaagtacaagctatagccacttttcctcgtcattttacatgaagggcagacatgcacttaaggtaggacccagaaattctgcttctaggcagacttatgtccaccaaaggctgccacagggaagttcatgcagacatcctcataattgccaaaagccagaaacagcccaatagccatcaatgggtgtctgaataaacaaattgtgatcaatttacacaatggcgcatccatacaataaaaagaacaaactacctgtgcacaccacagcatagatgaatctcagaatcattatactgagcgaaaaaaaaaaaaaaaaaaaag

SEQ ID NO: 81580 - DNA, 514 bp, Homo sapiens
  misc_feature (1)..(1): n is a, c, g, or t
nttcggcacagattttctagtttatttgcgtagaggtgtttatagtattctctgataatggagatatgaccactgatcccacagaaatacaaactagcaccatgagcttcaataccctgcaaacactcccaccacgcccaccaacccatgcctgaatatgcaataaatgccaggagacacggcactctctctgactcagaccaatgggaacctgatgacaagggaggtaaatggccagcgtcatggggcagccttcccaacatgccacttctcaagtccggcggctcaccccaaaggaagagaatgagggtgacaggctgcaggagaggtccaggccttgaacggggatataaaggctacatcacacacattcctcagtactagtcaacgggacactgagatgacatttattgaggaactactaaaaagctgacacatatctttcatctttatgagaactctgtagagaggcattatcatccccggctaagaaatgagaaaacaaaactgagct

SEQ ID NO: 81581 - DNA, 175 bp, Homo sapiens
gacagctaagtattttctgaataagaactttccagaagtgatgactcatgatattaaaaaagtacttaaggcaatgagaaaagagttctcctttttcatgaagtacaaataagaaaatagaatggtattttaagaagctcataacaaatgagttttctttttcatttaagctctg

SEQ ID NO: 81582 - DNA, 263 bp, Homo sapiens
ttttataattattagggatattcagaagttttgtacttgagattagtgactgaatttatgtagacagctttcttctgtggttatacaggtaatctataattttattgcatgttgttgatgctatatgacttactcactgtttcttgaaatcacccttttttgctgaaacaaatagaaaaataagtatatcataatttaagaatattgtatgtatttaagtgatctaagtatccacctacttactaaattaattacttattatg

SEQ ID NO: 81583 - DNA, 334 bp, Homo sapiens
gtcactctgtggcacgggatgtgaatcacttgctcctcgtgttcctcgttcctggcccgtctccccagaggacagcaagctctgtccatattgaccatgactgggttcaggcctgagacctcagggcacctgactgctctgtgtgcagtgtgtgtgaggggcaggtgtactcacctgcccctcactgcctgccagaggcctctgtgggcagccgtggggtccagcctggcccattttttgttttgatgctgcactcattgtccgagcctgctgggtggtctgagctctaagtgtggcatcctggtgctgtggagggcatgtctttgaccacgct

SEQ ID NO: 81584 - DNA, 422 bp, Homo sapiens
ccctgtcatagttcttcaggctgtattatgcataccacatcctctgtagccctcagcctatggtggaacgaaacgaaagaaaaaaaaagtaacaattacatctatttgatgtttcttctgcctatgaggtctttgtataagtaatgcacactaaccaatcatgccattggctctccatgaggtctttgtaaacctagaaaatgtttttctctattgaaacaaatctcattattaaaacatactgagacagagtaagatggctaaacaggagcctccactgatcatccatcctcctcacaggaacaccaaattgaacaactatccacgcagaacgcgcctaattgccatttactccatggccactgccatatccatcagatcctcctctaaagttacttcctggtcctggtccgaaatttcca

SEQ ID NO: 81585 - DNA, 430 bp, Homo sapiens
aggaacaagaagatgagaagaatatacaaactaggaaaagcaaaaagaacaggtgcaggaattagaaggcctataatgacaccttttatcccctccccaattcacgaaatttgaaaaagtccaagactatcacaacaaaaaagaaggaaaaaatggccgggtgcagtggctcacgcctgtaatcctagcactttgggaggccaaggtgggtggatcatgaggtcaggagatctagactatcctggctaacactgtgaaaccccgtctctactaaaaatacaaaaataaaattagctgggcatggtggcaggcacctgtagtcccagctactagggaggctgaggcaggaggatggcatgaacccaggaagcggagcttgcagtgagccaagatcgcgccactgcactccagcctgggcaaaagagcaaga

SEQ ID NO: 81586 - DNA, 387 bp, Homo sapiens
  misc_feature (15)..(16): n is a, c, g, or t
  misc_feature (41)..(41): n is a, c, g, or t
  misc_feature (87)..(87): n is a, c, g, or t
  misc_feature (155)..(155): n is a, c, g, or t
gtctgagaggacccnngagaggacaggaggaagggaagcangagcccaaagcagcagccagacagagccccaaaaggtgccctgggnagacctagggcgcacaggctgtcgggcgagaagggaatcaggctgcacgagacgccggcgcggccagngggcgataagcccaagtggtcatccaaccttcccctttgggaagcaggctcgatcagttggtaaggggccatgatatggcatctgagtaggtctacagtagaccccaaacccgtgatccctcttctgacaggacgctcctgctgagactccctggcctgagtcgccccagcttgccctgacatctgtacacaagccagcctgagtcctagcaccagggcatgcagaccctct

SEQ ID NO: 81587 - DNA, 768 bp, Homo sapiens
gagggggtaaataaatcgagtcccttttacttcatcttggccagaagaagaaaagaagaagtctcctggtgtcttttaaacactctttgaaaaccaaactttaatagttgtgcaacaatccaaagtaggatgtgccttaatttttcaaaagtattgttcctcctttttgggaagctttaagttgccttcctaattttagcctactataaataaaaaactacaatgaacatcaacatccttagaagtagctatactttcaagttgacaatacaatgtttgtagcctatgcaataccacagctttccaccactggctttctacctcggcttgaatgaagagaaactaaaaaaaaaggtaagattaaatctaaaggtatggatctggcatattgtctctaaaataactcaatgattggtctttctgctttttataaagtgtatcttctatcccaacactaccctaaattaagcaagaaaaaagaataaatgaagaaaaaaaatccataaaaatttcccactagtatggaagacaaggaatatattcttttaaaaaaatctgcatttgagagggaacactgcttttttggggggatgggggtgggggacaaggtctcactctgtcacccaagctagagtgcagtggcatgatcatgccttatagcagcgtcaacctcctggcctcaaacagtcctctctgcctcagtgccccgagcagctattaataggaccacaagcatgcgccaccacgcctggctaatttttgtacttt

SEQ ID NO: 81588 - DNA, 297 bp, Homo sapiens
catttctttgtattgtgccactatgagaagagtaccttgattattttctaatgaataatatttttaacagtaataattttaacaataactagtttaatttctgagagccttttcttaaaagtatcttctgtcacatgaattatctcattcccttcatgcccctgccactgggtccttttttccctctgtttaccttgtttactctcattagactttcctcaaatgtgattcttacacccatatacgtgtgcgtgtgcacgtgagtgtgtctgtgaattaaaagcctaattgagacct

SEQ ID NO: 81589 - DNA, 844 bp, Homo sapiens
ccaacatgaaacagaaaaataccatctcaggctccatattccatgtccctgttgaatacagatccccgaactgagaaataagaaacaactacatacgaagtaatacttgaaaatgtttctcttgtaatacttccatatccaaagcatttgaatatatttattttattgatgtaggtctgccaactcttccttctcaggaaggactgtttttattccaaacatgtatatataaggttaaaatgtattttttaaaataagataattattgatagttgtttttaaaatagccttgcttagcaaaataaatgttggcaaccctaagtttgttctattataatattattgaaattacattgaattctgaaatccatgtcaacttgaagttaccaagttttaaccactgttagaaaataagcaggaatgaaatctgtttcaagcgtttcaatttcaatacaatttaataaacaggctttgagcatctacccccacccccttttggtttttttgcaagcacctggaggcagagctcatgtggagcttacaatttagtaggaacacaggcattaattacaaagtaattacaatgctgatgagtgtgttgaagtggagggggctatggggcttcagccccaaaaagctaaacctgcaggctaaaactttaaaaaaatatatttaattggcaaataaaaatagtatacatttatggtgtacaacatgttttgttatatgtatacactgtggaatcactaaatcgggctaattaacatatgcattatgtcacatatttatcattttgtaatggtgagaacatttaaaatctctgtgagcaattttcaagtataca

SEQ ID NO: 81590 - DNA, 183 bp, Homo sapiens
ggcagacacagctgtcagggtggttgacggcatgcgctctggagctgcctgcctggccttgcctcttgcctttcccgctcataagccatgtgcctcagtttcctcttatagagtgcatccaccttgcaggacctccatgagggtccaacaagtccttgcatgaaaaatgcccaaaatggtaaa

SEQ ID NO: 81591 - DNA, 766 bp, Homo sapiens
aaagttaaaaccctctccccttcagattaatgaaaatattaggatgcatagaacacaatgggcactggtgatatggcccatggtagctgaattagattgagtataaatgaagtcttcacataatagcgaagaggccaacagaagaaaggccagaaagccacttgaaactcatgtccatggaagaccaaatgaagttgatttaactgttcccttagaaagatattatcccattgcttagccctcaaagtgctcatactgctactttccttctttatatcaccagttctgggagcaaacctcctgaaagaatggaagtatagactgtaaatacaagactgtgggtacagcaaaggggctctgatgctctagttgtttgtgtctagatactgtcaaatgtcccttgtgatgcacaattgcccttagcggagaaccattaaccaaaataaatgaaataatatgtcatgttcatgcatcagaagacccaatgttgttaagatatcaattctctataagttgatctatagactcaatgtaaccccaatcaaataccccactggctttttgtctacatttacaagtgaattctgaaatgtatatggaaattcaaagaacctaacacaatgaaaacaattttgaataagaagagcaaagctcaagcatttgactacgtgatttcaaaacgtataaagctactgtaaccaaatcagtttggtattagtctaaagatggataagggaggctgaggcagtagaattgcttgaaccca

SEQ ID NO: 81592 - DNA, 452 bp, Homo sapiens
gaataatgcctgccccaagggaggtcttctttaacatctatttagtcatgtgttatttataaacagcttgaattaatactgtaaaatagacggatgtctaagaatctaggctgtagcctaaagctaaatgaacctgagggtagacaagttcactctgtattaaccaaaggataatgaatgagttcaccgctcagttcaataagcttcttctgaaatatgcttcctcctggacttctaagaaacaggccaaaagtttaattatcccttaaaacatgttaagcctaaatagaaaaaggaaattaatcatttatagattttctcttctttattatgattcagttggtgcatctgtagatggctaagaattttccaaaccacgtgaattcagagaggcaacacttttgttgttgttgtttttccaggtaatgagctcgctttgaaaaccagtcact

SEQ ID NO: 81593 - DNA, 3082 bp, Homo sapiens
  misc_feature (4)..(4): n is a, c, g, or t
  misc_feature (8)..(8): n is a, c, g, or t
  misc_feature (10)..(10): n is a, c, g, or t
  misc_feature (12)..(12): n is a, c, g, or t
  misc_feature (16)..(18): n is a, c, g, or t
gggncgancnangctnnngagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagctcttcgtgatcgacaacggcgcggatgactggcggatagccatgacctacgagcgcatcctctacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaa

SEQ ID NO: 81594 - DNA, 1168 bp, Homo sapiens
tgaaggatccctattgactctgcagggtttgatttcagtaccttagacagctatctggtgacttcccagtaggcacgaacaaccccttctctccccttgcagtcggtgggcttgatgacgccccagacagtatcctttccttctctactgccgccaaaataaacattagggaaatgggatcattaacaccactgagaaaggagtttacagggatcgcaatagtaactgtctgcttgtggtagtagaaagcttgtgccaggctgcatgaatagaaattaatgttaaactcctgttagacgagtaatatgtagatttttattgaaacagaccacagcttattaaaaagtactcagtgcaatggtatatacatatatacagatagaaaaaaatataactgtgatctttttgtcttacgccattactggaaacacccaaacgtgaactggagttccctctgaacaaaaccattgtcaaatcttcaacatatgacctccaaatctaggtgccaagtgccctgtgacagttgtttacacacctgaaaaatgtatcctggaagctgtaatcttgggcctgggctatgtgttgaaacaagcaaaagagacacatcgtgaccaaccaagctggtggaggaaaagcacaaaattcaactccaacctgcagttaggatcccaaagagatgttgacatttatagccaaaaagaaaaagtacatatatatatatatatatatatatatatatatatatatatatatatatctgaatcagatcgaagcagccaacgtccagcttcactcaagaaggacaaggaataaacaacattctctagctgtgtcatgttgtctcagtttttgaatctcaaccaggactgatccaccttcatcagatacgttttttaatggcgcaacaactcaattttggtcccagactctccattctgcactggccacgagaacaacaagagaatgacaggatgttaatggaggaaacattttcatggcaagctcagaaactgaagtgtttatattcagaatcagatgagctttaatatgaatttgcatcttgcctctgtactgcttgctattttttaatgataggagaaagcataacagtttattttaaatatgaaatatattgatatattataaaatatattgtaactttcaatta

SEQ ID NO: 81595 - DNA, 3509 bp, Homo sapiens
  misc_feature (4)..(4): n is a, c, g, or t
  misc_feature (8)..(8): n is a, c, g, or t
  misc_feature (10)..(10): n is a, c, g, or t
  misc_feature (12)..(12): n is a, c, g, or t
  misc_feature (16)..(18): n is a, c, g, or t
gggncgancnangctnnngagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagctcttcgtgatcgacaacggcgcggatgactggcggatagccatgacctacgagcgcatcctctacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtgccaagtgccctgtgacagttgtttacacacctgaaaaatgtatcctggaagctgtaatcttgggcctgggctatgtgttgaaacaagcaaaagagacacatcgtgaccaaccaagctggtggaggaaaagcacaaaattcaactccaacctgcagttaggatcccaaagagatgttgacatttatagccaaaaagaaaaagtacatatatatatatatatatatatatatatatatatatatatatatatatctgaatcagatcgaagcagccaacgtccagcttcactcaagaaggacaaggaataaacaacattctctagctgtgtcatgttgtctcagtttttgaatctcaaccaggactgatccaccttcatcagatacgttttttaatggcgcaacaactcaattttggtcccagactctccattctgcactggccacgagaacaacaagagaatgacaggatgttaatggaggaaacattttcatggcaagctcagaaactgaagtgtttatattcagaatcagatgagctttaatatgaatttgcatcttgcctctgtactgcttgctattttttaatgataggagaaagcataacagtttattttaaatatgaaatatattgatatattataaaatatattgtaactttcaatta

SEQ ID NO: 81596 - DNA, 2004 bp, Homo sapiens
cacaacgcagaaaaaaagaaacatctatcggctaggtacgaggctgggtggtgcaggaaagtcagcttgaaggacactccttgcagggactgagctggcacctactccttagagcttgctgataccaggcctgccacgcgacatctgcaaggacagttgtttggtgttttgcttcaggttatagatggagagacctataaaggactccatgttttcgttggccctgaaatgccttatcagtctgtccaccatcatccttttgggcttgatcatcgcctaccacacacgtgaagtccagctcttcgtgatcgacaacggcgcggatgactggcggatagccatgacctacgagcgcatcctctacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaa

SEQ ID NO: 81597 - DNA, 1921 bp, Homo sapiens
gatggagaacagcaggcactggctttagcggggagctggccccactgctccagcctctcagtccagccccaagacggaggagggggtttccctcccagagggagtggagatggaggaaggactccatgttttcgttggccctgaaatgccttatcagtctgtccaccatcatccttttgggcttgatcatcgcctaccacacacgtgaagtccagctcttcgtgatcgacaacggcgcggatgactggcggatagccatgacctacgagcgcatcctctacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaa

SEQ ID NO: 81598 - DNA, 311 bp, Homo sapiens
gtattccacatggggctttctgagtacagagcctgtgctgggacagggaagggaggaggagtaggggtgccaggaagtatgtggtctgatggaggagacaggcatgtacccagacacctgaaaggagacaatgggaaagaggggagtgctgagttggggttcagtatgagctagaattgcagcattggaaccaaagtaaggtgggaaaaaggcacagaattttcctgattttctgttccttctttgcaaaccaatatatcaaagcattctggttacatcagtaactcacatataacacattgcaacttact

SEQ ID NO: 81599 - DNA, 3248 bp, Homo sapiens
  misc_feature (4)..(4): n is a, c, g, or t
  misc_feature (8)..(8): n is a, c, g, or t
  misc_feature (10)..(10): n is a, c, g, or t
  misc_feature (12)..(12): n is a, c, g, or t
  misc_feature (16)..(18): n is a, c, g, or t
gggncgancnangctnnngagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagctcttcgtgatcgacaacggcgcggatgactggcggatagccatgacctacgagcgcatcctctacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtgcctctacttgggagcgggaagaggagatgacaggaagcgacgcctctggcagggcccttgctgcagagttggtggagaacagaaatccacgctcaatctcaggtgccaagtgccctgtgacagttgtttacacacctgaaaaatgtatcctggaagctgtaatcttgggcctgggctatgtgttgaaacaagcaaaagagacacatcgtgaccaaccaagctggtggaggaaaagcacaaaattcaactccaacctgcagttaggatcccaaagagatgttgacatttatagccaaaaagaaaaagtacatatatatatatatatatatatatatatatatatatatatatatatatctgaatcagatcgaagcagccaacgtccagcttcactcaagaaggacaaggaataaacaacattctctagctgtgtcatgttgtctcagtttttgaatctcaaccaggactgatccaccttcatcagatacgttttttaatggcgcaacaactcaattttggtcccagactctccattctgcactggccacgagaacaacaagagaatgacaggatgttaatggaggaaacattttcatggcaagctcagaaactgaagtgtttatattcagaatcagatgagctttaatatgaatttgcatcttgcctctgtactgcttgctattttttaatgataggagaaagcataacagtttattttaaatatgaaatatattgatatattataaaatatattgtaactttcaatta

SEQ ID NO: 81600 - DNA, 1973 bp, Homo sapiens
gtgctgctcagtgtcaaatgaacaggaaagtcagcttgaaggacactccttgcagggactgagctggcacctactccttagagcttgctgataccaggcctgccacgcgacatctgcaaggacagttgtttggtgttttgcttcaggttatagatggagagacctataaaggactccatgttttcgttggccctgaaatgccttatcagtctgtccaccatcatccttttgggcttgatcatcgcctaccacacacgtgaagtccagctcttcgtgatcgacaacggcgcggatgactggcggatagccatgacctacgagcgcatcctctacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaa

SEQ ID NO: 81601 - DNA, 2555 bp, Homo sapiens
  misc_feature (4)..(4): n is a, c, g, or t
  misc_feature (8)..(8): n is a, c, g, or t
  misc_feature (10)..(10): n is a, c, g, or t
  misc_feature (12)..(12): n is a, c, g, or t
  misc_feature (16)..(18): n is a, c, g, or t
gggncgancnangctnnngagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagctcttcgtgatcgacaacggcgcggatgactggcggatagccatgacctacgagcgcatcctctacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcatta

SEQ ID NO: 81602 - DNA, 4789 bp, Homo sapiens
  misc_feature (67)..(67): n is a, c, g, or t
agaatatgttgcttaagtccaactgtgttttggaagcttttggaaatgccaaaaccaaccgtaatgncaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtaagatttccttcctggttttctgcctttggtatcatcttcctctgtccttactgtccacggtccctgttcaataagccaaagaccctggtgccccgcccagacccctgggctgacgtccagaccaatctcaccccagaggcaactggatggtgcctttagttggtgcggatgccccgtggccaggtcaagtcagagcacctggacaggtgtcctccctgctgctgaccctgcagagggaaggggtggggatgcaggaccccgctctgcgggagccccatagccacctctcttgcccaaggtgagccagccctggggacccagctcagggaggctctgctcagagttcggcggacccaccccaacccaactcccagccgccagccaaagccactgggtgagcagagtcacccacagggccagcccctcagccaggagccagtggcaggagcggaacagcccatccagcagagtgagtccatccttcccaggttctcccctgggagactccctttgccaccaaggcccccaccagggcctctgaccaccgctctggagaggacagtgtggcatgctccaaggatcatcttacttaactcgcagcctgtggctgtggtcctcttatagatactttcaccgtttgcagggttgctaatcagatacctgctgtcaccacacttgggtcaggaaccctaatgagaacggggagctgccagggtgagggcagccctcagggtcggccgctttccctctggaccacctcccgctgcgtttcctactcagagaaacagcaagggcggggtcaagacacgggatgacgggaagcaggaagcggggcagcagcacagcgtggggtcctggcactgcaggccaggccaggatgcccaccccgccctctacacggccccttggggcctgcgcccgtgaaactggtgccagggagcactgccagcttgccagtttctgcccagcaaaagcacgtatgcttcaggggccttctgagaccaccttccccactgagccccagctgctgagaaggccttgagggaagtagaggctgggagcaaatgccccatgcggtgagaggatgaggggagcctacgcctcaggcatgtggtgagaggatgagggggagggagccaacgcctcaggtggagtgggcagaggtgcaagagagggatgtactgaagcttcttcccgtcctgccacagacacttctcctgccttcccaccctgacccggcagaacccaccaagtgcctgtgtgcagcctcctgtgcctcacccagggcctgaccccagagtggtcccaacaacccggtctcatgcccactccccatccctgcttcccaaaaattgcactgtgtgcagtttgcaacaaagaatcccgctggcatcctgtccttgggaaccctttctcattctccaagcctggtcagctgcctgcacaggcagaggtgccctcagcccagattagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggcctcccagctgaggccacaggacaagcacttttttatgatgtactaaaagccacagtatgtggcaactgcaaaaggatcaggaatttagggtatgatctcggtcacgtgtcccgggcgctgaggggaaaggaagcgggcatgattgtagacaatgagggggttctcttgatgtaatgaaatgcaattttatggtttggtgcaaaaactcctattttccagtaaattaactttatttctaaagcatattttgatttgccatcaagagcaataaagcattaaatcttatttttaaaaaaaagttctgct

SEQ ID NO: 81603 - DNA, 423 bp, Homo sapiens
ttgggccccttagccccaggcaccatccaaaggctgggaggaaagaacccaaacccaggccctcctcctcccagcctttggatggtgccttgggccccttagccccagcgccagggcctcccagctgaggccacaggacaagcacttttttatgatgtactaaaagccacagtatgtggcaactgcaaaaggatcaggaatttagggtatgatctcggtcacgtgtcccgggcgctgaggggaaaggaagcgggcatgattgtagacaatgagggggttctcttgatgtaatgaaatgcaattttatggtttggtgcaaaaactcctattttccagtaaattaactttatttctaaagcatattttgatttgccatcaagagcaataaagcattaaatcttatttttaaaaaaaagttctgct

SEQ ID NO: 81604 - DNA, 327 bp, Homo sapiens
  misc_feature (6)..(6): n is a, c, g, or t
  misc_feature (14)..(14): n is a, c, g, or t
  misc_feature (95)..(95): n is a, c, g, or t
gcagtntggggaanaaatcacaaacacttacttggagaaacagagaccatagtgtagattttacaaaatcacttttaaaatctctgtattgtgcncctcaaatacctagagccagtctttgcataaaatatcacagcgctgaggggaaaggaagcgggcatgattgtagacaatgagggggttctcttgatgtaatgaaatgcaattttatggtttggtgcaaaaactcctattttccagtaaattaactttatttctaaagcatattttgatttgccatcaagagcaataaagcattaaatcttatttttaaaaaaaagttctgct

SEQ ID NO: 81605 - DNA, 2447 bp, Homo sapiens
ctggagatacacggagcccagaggaagcagggagggtggaggcaggggccaccctgctgagcgggagtcaggagagccctgcacggaggagcatgccccgattgtctgaacacgagaggtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtaagatttccttcctggttttctgcctttggtatcatcttcctctgtccttactgtccacggtccctgttcaataagccaaagaccctggtgccccgcccagacccctgggctgacgtccagaccaatctcaccccagaggcaactggatggtgcctttagttggtgcggatgccccgtggccaggtcaagtcagagcacctggacaggtgtcctccctgctgctgaccctgcagagggaaggggtggggatgcaggaccccgctctgcgggagccccatagccacctctcttgcccaaggtgagccagccctggggacccagctcagggaggctctgctcagagttcggcggacccaccccaacccaactcccagccgccagccaaagccactgggtgagcagagtcacccacagggccagcccctcagccaggagccagtggcaggagcggaacagcccatccagcagagtgagtccatccttcccaggttctcccctgggagactccctttgccaccaaggcccccaccagggcctctgaccaccgctctggagaggacagtgtggcatgctccaaggatcatcttacttaactcgcagcctgtggctgtggtcctcttatagatactttcaccgtttgcagggttgctaatcagatacctgctgtcaccacacttgggtcaggaaccctaatgagaacggggagctgccagggtgagggcagccctcagggtcggccgctttccctctggaccacctcccgctgcgtttcctactcagagaaacagcaagggcggggtcaagacacgggatgacgggaagcaggaagcggggcagcagcacagcgtggggtcctggcactgcaggccaggccaggatgcccaccccgccctctacacggccccttggggcctgcgcccgtgaaactggtgccagggagcactgccagcttgccagtttctgcccagcaaaagcacgtatgcttcaggggccttctgagaccaccttccccactgagccccagctgctgagaaggccttgagggaagtagaggctgggagcaaatgccccatgcggtgagaggatgaggggagcctacgcctcaggcatgtggtgagaggatgagggggagggagccaacgcctcaggtggagtgggcagaggtgcaagagagggatgtactgaagcttcttcccgtcctgccacagacacttctcctgccttcccaccctgacccggcagaacccaccaagtgcctgtgtgcagcctcctgtgcctcacccagggcctgaccccagagtggtcccaacaacccggtctcatgcccactccccatccctgcttcccaaaaattgcactgtgtgcagtttgcaacaaagaatcccgctggcatcctgtccttgggaaccctttctcattctccaagcctggtcagctgcctgcacaggcagaggtgccctcagcccagattagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggcctcccagctgaggccacaggacaagcacttttttatgatgtactaaaagccacagtatgtggcaactgcaaaaggatcaggaatttagggtatgatctcggtcacgtgtcccgggcgctgaggggaaaggaagcgggcatgattgtagacaatgagggggttctcttgatgtaatgaaatgcaattttatggtttggtgcaaaaactcctattttccagtaaattaactttatttctaaagcatattttgatttgccatcaagagcaataaagcattaaatcttatttttaaaaaaaagttctgct

SEQ ID NO: 81606 - DNA, 4322 bp, Homo sapiens
  misc_feature (67)..(67): n is a, c, g, or t
agaatatgttgcttaagtccaactgtgttttggaagcttttggaaatgccaaaaccaaccgtaatgncaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtaagatttccttcctggttttctgcctttggtatcatcttcctctgtccttactgtccacggtccctgttcaataagccaaagaccctggtgccccgcccagacccctgggctgacgtccagaccaatctcaccccagaggcaactggatggtgcctttagttggtgcggatgccccgtggccaggtcaagtcagagcacctggacaggtgtcctccctgctgctgaccctgcagagggaaggggtggggatgcaggaccccgctctgcgggagccccatagccacctctcttgcccaaggtgagccagccctggggacccagctcagggaggctctgctcagagttcggcggacccaccccaacccaactcccagccgccagccaaagccactgggtgagcagagtcacccacagggccagcccctcagccaggagccagtggcaggagcggaacagcccatccagcagagtgagtccatccttcccaggttctcccctgggagactccctttgccaccaaggcccccaccagggcctctgaccaccgctctggagaggacagtgtggcatgctccaaggatcatcttacttaactcgcagcctgtggctgtggtcctcttatagatactttcaccgtttgcagggttgctaatcagatacctgctgtcaccacacttgggtcaggaaccctaatgagaacggggagctgccagggtgagggcagccctcagggtcggccgctttccctctggaccacctcccgctgcgtttcctactcagagaaacagcaagggcggggtcaagacacgggatgacgggaagcaggaagcggggcagcagcacagcgtggggtcctggcactgcaggccaggccaggatgcccaccccgccctctacacggccccttggggcctgcgcccgtgaaactggtgccagggagcactgccagcttgccagtttctgcccagcaaaagcacgtatgcttcaggggccttctgagaccaccttccccactgagccccagctgctgagaaggccttgagggaagtagaggctgggagcaaatgccccatgcggtgagaggatgaggggagcctacgcctcaggcatgtggtgagaggatgagggggagggagccaacgcctcaggtggagtgggcagaggtgcaagagagggatgtactgaagcttcttcccgtcctgccacagacacttctcctgccttcccaccctgacccggcagaacccaccaagtgcctgtgtgcagcctcctgtgcctcacccagggcctgaccccagagtggtcccaacaacccggtctcatgcccactccccatccctgcttcccaaaaattgcactgtgtgcagtttgcaacaaagaatcccgctggcatcctgtccttgggaacccgtagacaatgagggggttctcttgatgtaatgaaatgcaattttatggtttggtgcaaaaactcctattttccagtaaattaactttatttctaaagcatattttgatttgccatcaagagcaataaagcattaaatcttatttttaaaaaaaagttctgct

SEQ ID NO: 81607 - DNA, 2943 bp, Homo sapiens
  misc_feature (67)..(67): n is a, c, g, or t
agaatatgttgcttaagtccaactgtgttttggaagcttttggaaatgccaaaaccaaccgtaatgncaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtaagatttccttcctggttttctgcctttggtatcatcttcctctgtccttactgtccacggtccctgttcaataagccaaagaccctggtgccgccagacctggtgggtcagacattaccaaagcaatggtggtgcttattgggggttcccgggagtaagtaagctggagggttcctggggactgaggaagggc

SEQ ID NO: 81608 - DNA, 1524 bp, Homo sapiens
  misc_feature (67)..(67): n is a, c, g, or t
agaatatgttgcttaagtccaactgtgttttggaagcttttggaaatgccaaaaccaaccgtaatgncaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaagtacagatggggtttcaccatgttgaccaggttggtcttgaactcctgatctcaggtcatccacccacctcggcctcctaaagcgctggcattgcagatgtgagccaccatgctcagccatctcaactattttgaagaagtgcatatacagatacagttttcatcttcaaagcaagtaaaat

SEQ ID NO: 81609 - DNA, 444 bp, Homo sapiens
aagaccaaaattttcattcgaacaccccgaacattgtttaccttggaagaactccgtgcccagatgctcataaggattgtcctctttctacaaaaggtaattttatattttatatataaggataagattttgcttttaagttcttaaaaatttgttgcatattttctttaattcaagaaatattcctggaagatatgttgttttatgtctatgcatatcttaaaatgttttctgttgccttcacacatggaaaacttacttggttgccccagttcaaaattatttttgcccaagttcaaaattattttatcttcaaaactctgaagatattttgtttttaaagttggagagatgtctgaaccagtctttctgtcctttactgttaactgtgttttttccttcagcttaaatgcataaaggactttttttttcccccccgagacg

SEQ ID NO: 81610 - DNA, 2549 bp, Homo sapiens
gggagccaagggccctgccatggtgccgaggctgtggttggaggcccagctagtgccacactcgccttgcctcggcctctctggggcccttcaggcatcctcctggcacttgtggaggaagcaggctgcgccggagccaatggtggccgggagctgccgggcaggtgccctgttctcatgctgcctgctaactgcccgtctggtgtttttggttcctgcagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtaagatttccttcctggttttctgcctttggtatcatcttcctctgtccttactgtccacggtccctgttcaataagccaaagaccctggtgccccgcccagacccctgggctgacgtccagaccaatctcaccccagaggcaactggatggtgcctttagttggtgcggatgccccgtggccaggtcaagtcagagcacctggacaggtgtcctccctgctgctgaccctgcagagggaaggggtggggatgcaggaccccgctctgcgggagccccatagccacctctcttgcccaaggtgagccagccctggggacccagctcagggaggctctgctcagagttcggcggacccaccccaacccaactcccagccgccagccaaagccactgggtgagcagagtcacccacagggccagcccctcagccaggagccagtggcaggagcggaacagcccatccagcagagtgagtccatccttcccaggttctcccctgggagactccctttgccaccaaggcccccaccagggcctctgaccaccgctctggagaggacagtgtggcatgctccaaggatcatcttacttaactcgcagcctgtggctgtggtcctcttatagatactttcaccgtttgcagggttgctaatcagatacctgctgtcaccacacttgggtcaggaaccctaatgagaacggggagctgccagggtgagggcagccctcagggtcggccgctttccctctggaccacctcccgctgcgtttcctactcagagaaacagcaagggcggggtcaagacacgggatgacgggaagcaggaagcggggcagcagcacagcgtggggtcctggcactgcaggccaggccaggatgcccaccccgccctctacacggccccttggggcctgcgcccgtgaaactggtgccagggagcactgccagcttgccagtttctgcccagcaaaagcacgtatgcttcaggggccttctgagaccaccttccccactgagccccagctgctgagaaggccttgagggaagtagaggctgggagcaaatgccccatgcggtgagaggatgaggggagcctacgcctcaggcatgtggtgagaggatgagggggagggagccaacgcctcaggtggagtgggcagaggtgcaagagagggatgtactgaagcttcttcccgtcctgccacagacacttctcctgccttcccaccctgacccggcagaacccaccaagtgcctgtgtgcagcctcctgtgcctcacccagggcctgaccccagagtggtcccaacaacccggtctcatgcccactccccatccctgcttcccaaaaattgcactgtgtgcagtttgcaacaaagaatcccgctggcatcctgtccttgggaaccctttctcattctccaagcctggtcagctgcctgcacaggcagaggtgccctcagcccagattagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggcctcccagctgaggccacaggacaagcacttttttatgatgtactaaaagccacagtatgtggcaactgcaaaaggatcaggaatttagggtatgatctcggtcacgtgtcccgggcgctgaggggaaaggaagcgggcatgattgtagacaatgagggggttctcttgatgtaatgaaatgcaattttatggtttggtgcaaaaactcctattttccagtaaattaactttatttctaaagcatattttgatttgccatcaagagcaataaagcattaaatcttatttttaaaaaaaagttctgct

SEQ ID NO: 81611 - DNA, 4727 bp, Homo sapiens
  misc_feature (67)..(67): n is a, c, g, or t
agaatatgttgcttaagtccaactgtgttttggaagcttttggaaatgccaaaaccaaccgtaatgncaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactgacgccccgcggaggcctggcccggagcccggccacactccgagtcctgggtcccagtccagctgctgcctcccaacccatgcccgctagaaacctgctgcgagggcccctcccagaggagccccgcccctgtaagatttccttcctggttttctgcctttggtatcatcttcctctgtccttactgtccacggtccctgttcaataagccaaagaccctggtgccccgcccagacccctgggctgacgtccagaccaatctcaccccagaggcaactggatggtgcctttagttggtgcggatgccccgtggccaggtcaagtcagagcacctggacaggtgtcctccctgctgctgaccctgcagagggaaggggtggggatgcaggaccccgctctgcgggagccccatagccacctctcttgcccaaggtgagccagccctggggacccagctcagggaggctctgctcagagttcggcggacccaccccaacccaactcccagccgccagccaaagccactgggtgagcagagtcacccacagggccagcccctcagccaggagccagtggcaggagcggaacagcccatccagcagagtgagtccatccttcccaggttctcccctgggagactccctttgccaccaaggcccccaccagggcctctgaccaccgctctggagaggacagtgtggcatgctccaaggatcatcttacttaactcgcagcctgtggctgtggtcctcttatagatactttcaccgtttgcagggttgctaatcagatacctgctgtcaccacacttgggtcaggaaccctaatgagaacggggagctgccagggtgagggcagccctcagggtcggccgctttccctctggaccacctcccgctgcgtttcctactcagagaaacagcaagggcggggtcaagacacgggatgacgggaagcaggaagcggggcagcagcacagcgtggggtcctggcactgcaggccaggccaggatgcccaccccgccctctacacggccccttggggcctgcgcccgtgaaactggtgccagggagcactgccagcttgccagtttctgcccagcaaaagcacgtatgcttcaggggccttctgagaccaccttccccactgagccccagctgctgagaaggccttgagggaagtagaggctgggagcaaatgccccatgcggtgagaggatgaggggagcctacgcctcaggcatgtggtgagaggatgagggggagggagccaacgcctcaggtggagtgggcagaggtgcaagagagggatgtactgaagcttcttcccgtcctgccacagacacttctcctgccttcccaccctgacccggcagaacccaccaagtgcctgtgtgcagcctcctgtgcctcacccagggcctgaccccagagtggtcccaacaacccggtctcatgcccactccccatccctgcttcccatttctcattctccaagcctggtcagctgcctgcacaggcagaggtgccctcagcccagattagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggcctcccagctgaggccacaggacaagcacttttttatgatgtactaaaagccacagtatgtggcaactgcaaaaggatcaggaatttagggtatgatctcggtcacgtgtcccgggcgctgaggggaaaggaagcgggcatgattgtagacaatgagggggttctcttgatgtaatgaaatgcaattttatggtttggtgcaaaaactcctattttccagtaaattaactttatttctaaagcatattttgatttgccatcaagagcaataaagcattaaatcttatttttaaaaaaaagttctgct

SEQ ID NO: 81612 - DNA, 2835 bp, Homo sapiens
  misc_feature (67)..(67): n is a, c, g, or t
agaatatgttgcttaagtccaactgtgttttggaagcttttggaaatgccaaaaccaaccgtaatgncaactcaagcaggtttggaaaatacatggatatcaactttgacttcaagggtgaccctattggtgggcatatcaataactacttactagaaaagtctcgagtgattgtgcaacagccaggagaaagaagctttcattctttctatcagctactccaaggaggttcagaacaaatgctacgctctctacatctccagaaatccctttcatcctacaactatattcatgtgggagctcaattaaagtcttctatcaatgatgctgccgaattcagagttgttgctgatgccatgaaagtcattggcttcaaacctgaggagatccaaacagtgtataagattttggctgctattctgcacttgggaaatttaaaatttgtagtagatggtgacacgcctcttattgagaatggcaaagtagtatctatcatagcagaattgctctctactaagacagatatggttgagaaagcccttctttaccggactgtggccacaggccgtgacatcattgacaagcagcacacagaacaagaggccagctacggcagagacgcctttgccaaggcaatatatgagcgccttttttgttggatcgttactcgcatcaatgatattattgaggtcaagaactatgacaccacaatccatgggaaaaacactgttattggtgtcttggatatctatggctttgaaatctttgacaacaacagttttgaacaattctgtatcaattactgcaatgagaaactgcagcagctatttattcagctggttctgaagcaagaacaagaggaataccagcgggaagggatcccctggaaacatattgactacttcaacaatcagatcattgttgacctcgtggagcaacagcacaaagggatcattgcaatccttgatgatgcttgcatgaatgtcggcaaagtcaccgatgaaatgtttcttgaagcacttaacagtaaattgggcaaacacgcccatttttccagccgaaagctctgtgcctcagacaaaattctggagtttgatcgagattttcgaattcgacattatgcaggcgatgtagtctattctgtcattggttttattgacaaaaataaagatactttatttcaagatttcaagcgccttatgtataacagttcaaatcctgtgctcaagaatatgtggcctgaaggcaaactgagcattacagaggtgaccaagcgacctctgactgctgctaccttgtttaagaattctatgattgctctagtagacaaccttgcatcaaaggaaccatattacgttcgttgcatcaaacccaatgacaagaaatctccacagatatttgatgatgaacgctgccggcaccaagtagaatatcttggactactggaaaatgtgagagtgcgtcgggcaggatttgccttccgccagacatacgagaagtttcttcacaggtataagatgatctctgaattcacctggcccaaccatgaccttccttcagacaaagaggctgtcaagaaactaattgaacggtgtggttttcaggatgatgtagcttatgggaagaccaaaattttcattcgaacaccccgaacattgtttaccttggaagaactccgtgcccagatgctcataaggattgtcctctttctacaaaaggtgtggcggggcaccctggcccgcatgcggtacaaaagaaccaaggcagctctgacaataatcaggtactaccggcgctacaaagtgaagtcgtacatccacgaggtggccagacgcttccatggcgtcaagaccatgcgagactacgggaagcacgtgaagtggccaagccctcctaaagttcttcgccgttttgaggaggccctgcagacgattttcaatagatggagagcatcccagctcatcaagagcattccggcctcagacctgccccaggtcagggcaaaggttgcagccgtggaaatgttgaagggtcaaagggctgacctcgggctccagagggcctgggagggcaactatcttgcttcaaagccagatacacctcagacctcaggcacttttgtccctgttgctaatgaattgaaacggaaggacaaatacatgaatgtcctcttttcctgtcacgtccgtaaggtaaatcgatttagtaaggtggaagacagagcaatttttgtcactgaccgtcacctgtataaaatggatcccactaaacagtacaaggtgatgaagactatccctctatacaatttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagagaaaccatctgcttatactctgaataaaattcaagaaagcatagattctacataaacaggcccaagattacatggcaaactgagatgaagaggatgctggctgagaaacaaacaaaagtgttcaattatttgaatgaagtaaggaaagatattttaaaatgtaaatcaacattaaaatctgaaaatggcacagttgatattgcagaaaatagaattgatgtgaaaggaaagtttgaagtctctcagtgtgcagaatttactgttataatgggcaacatgttaactttcttagcaatatacaaaataagggtacatcttacaaagaaggcatcttatattcaataaaatatggtaatttaaaacatacaaaaagaa

SEQ ID NO: 81613 - DNA, 197 bp, Homo sapiens
tggggtcaggaggctgggggcagacttcaggacggaagccaggagctgtgaatcctctcccttcccgccagggggtggcataaatcagggggcgggcagtggttccttcgggacactagtgtaggagagaaagtgagcgtccttccctttgaaagggcacagcagggaaggatggataacttggcagaggcctgggg

SEQ ID NO: 81614 - DNA, 951 bp, Homo sapiens
ggactacaggcccccgccaccacgcctggctagtttttgtatttttagtagaggtggagtttcaccgtgttggccaggctgatctcaaactcttgacctcaggtgatcacctgccttggcctcccaaagtgctgtgattacaggtgtgagcaccatgcccagcccaagataagccgttttaaagtagatatgtcaacaaatgcattttaaaacttaatttagataaaattgtctttgtatgctttaagatgatctttatagtataatcttgcctaatatgctgattaaaagtagttttttttccttcaaatcatttaatcacatttactacttaaatgatgaaatgtcgccaggagttcttattactgtggaagatgacttcaagggaagaaaaagttaaaagtatttttagtgattccttatcctggttcatcagaatttgggaagcttttacaaaatacacattcctcgctgggcaggatggctcatgctgtaatcccagcacttgagatgccaaggcaggtagattgcttgagcccaggagttcaagaccagtttgggcagtatagtgagaccctgtctctaccagaaaataaaacattaaggatggtggtccctgcctgtaatcccagctactcgggagcttgaggtgcagggattgcttgaacccaggaggttgaggctggtttgaaccatgatggtgctgctgcactccagcctgggcgatagagggagtactctgtctttaaaaaagaaaaaagtgaacaaagtgaacacctgtgaccaaatttgaacacaaggtttatgaccattacactaagactggtatagctaattgggaggctgaggtgggaggattgcttgagccttggaggtcaaggctgtggtgaattctgattgtgtcatgcgttccagcctgggtgacagagtgagaccttgtctcttaaaaaa

SEQ ID NO: 81615 - DNA, 444 bp, Homo sapiens
  misc_feature (15)..(15): n is a, c, g, or t
  misc_feature (25)..(25): n is a, c, g, or t
  misc_feature (126)..(126): n is a, c, g, or t
  misc_feature (197)..(197): n is a, c, g, or t
attaacccctactcntgtttccaanacctccatccaaaagatcaacggttagagacaagaagccattaagaaaattaagtcgataatgaaatacctagatgatgagccataaaaatgtaaatgatncctaaatatttggttccacgatttttgttaccttttttcctttttttttgagacagagttttactctgtcncccggttggagtgcagtggcgatagagggagtactctgtctttaaaaaagaaaaaagtgaacaaagtgaacacctgtgaccaaatttgaacacaaggtttatgaccattacactaagactggtatagctaattgggaggctgaggtgggaggattgcttgagccttggaggtcaaggctgtggtgaattctgattgtgtcatgcgttccagcctgggtgacagagtgagaccttgtctcttaaaaaa

SEQ ID NO: 81616 - DNA, 417 bp, Homo sapiens
gacggagtctcgctctgttgcccaagctggagtgcagtggagggatctcagctcactgcaacctctgcctcctgggttcaagtgttctcttgcctcagctactcgggagcttgaggtgcagggattgcttgaacccaggaggttgaggctggtttgaaccatgatggtgctgctgcactccagcctgggcgatagagggagtactctgtctttaaaaaagaaaaaagtgaacaaagtgaacacctgtgaccaaatttgaacacaaggtttatgaccattacactaagactggtatagctaattgggaggctgaggtgggaggattgcttgagccttggaggtcaaggctgtggtgaattctgattgtgtcatgcgttccagcctgggtgacagagtgagaccttgtctcttaaaaaa

SEQ ID NO: 81617 - DNA, 384 bp, Homo sapiens
gccacagtttgctttgtaggaaggtttctaattacaaatctgattttaaaaataaatatagggatatacatttttatttttcttaagtgaactttagtggtttgtgtcttcaaagagagtttgttcattttattttatttcccagatttattggcataaatgggttcatgattttcctttcaatatctgtagaatctgtcatgtctctcattcccaatctggggtaatttatgtgcttctttgtaacttgataatccttgggctagaggtttatcagttgtattgttcttaagggcttttgggtttcactgattttcttcacaggttcattctgtttatttcattgacttcccattttaatctttattatatactctcttctgc

SEQ ID NO: 81618 - DNA, 559 bp, Homo sapiens
ggggatattttgaatttgaggtgcctgtgggatgtctatttggagctagcctgtagacattggattaggggagagatgcacatgctacagatactgatagggtaacagttagcagtaatggtaagtgcagccattgcaatggttgtctgtaatgtgagaagacaagatgaagaatagaaccctgcagatcacccatgtttaagagacagggcaggttagaagaaggggaccttgcaaaggaaacaaaaaaaaaatgcataggaagactatggcagtgaagtatgatgaaagctaagataaaagttgtttcaaaaggacagagtagtcaacaatgtccagtactgtagtaaagtaaggtagttaggccaacatagtatctagccatgtagttcatgaccttgataagaacaagttaagtagacttcagtggtttattgagtatggagccaaagtacagtcactgagaagtaaataagaaacaaaaatggctgggcacggtggttcatgcttataatcccaacattttgggagaccaaggcaggtggtggattgcttgagc

SEQ ID NO: 81619 - DNA, 346 bp, Homo sapiens
cattggcctgggcctccttctcttgaccgaactctcatccaacctaggcaacatttggattcaatttgatagaaaatgtgggtgagctgcttgccaaattcttatgaatctgtgtcaaactcagtgatttaggctaagatttggggtgtggctgagtccccagaggaattctgtggttgcataattcacagaaagtgaagcaaagggtattttcaaaactatttccaaagaagtggactctgtagaatctcagtctatggggattaagattttggagacttcaccacagaatttaagtcttttcacagtatgtaatggtcttttagggatgtttaaccatctgttc

SEQ ID NO: 81620 - DNA, 533 bp, Homo sapiens
cattccattttattgctgaatgctattctgttgtattgatataccacattttgtttatccattcatcagctgatggacagttgggttgtttctgttttttggttatgaataatattgcagtattgctaagaacgtgtgtataagtttttctgtgggtatatgttttcatttctcaaggagatacctttaaagctgcatccatccatatctctactttgtggttaacattctcctaggttatgcagtttgtttgaggaagaacagtgttttagtaaactcttgatcctactgtggtgttgcggatattgccctgaatcaagaaaaggtgccaccaaaaaaaaatccaaaacccaaaaacaaaaagagagaatcctgtttttaagtttgaactctccagtagcattgtttccaaatatttggtgcagaactttaaccattggtgagagttgacagacgcgatagtgcctaaattcaatgcacatgtactgctgctttaaacaaataaagaggattttcaatgcgaagcctcagct

SEQ ID NO: 81621 - DNA, 798 bp, Homo sapiens
tttttgagacaagatcttgctctgttgctcagtctagggtgcagtgacgtgatcatggctcactgcagcctcaaccttgaagactcaagtagctcagactataagcacacaccaccacacccagctaatttttttatttttttgtagtgatgggatttttttattggccaggttattctcgaactcctgagctcaagtgatccttccaccctggtcccctgaagtgctgggattacaggtgtgagccactgcgcccagaccgtatgaacatgctaatgtaatatctaactctctctcaatccgtcgaacacctgatcttggagtactattatgtattcatggagcgcgcctgtgttttgggaaggtggaatgaggagatggccgtgcttcgaggagggacgatggcgtgtggatgcccaactcctttgggagtgccttctgcatcggccttggattcgatctgaagagtacacgtgatgtgccgccgtaaatatgttcgcctagatcctacttgatagcagcctcctctggcccaaatcagaactacacgacgagagtgatgctcctaggataccgtcagcgctccttggattcacccctgttcagagcctccatggctccccagtgccttatggaggcctcccaggctcctccagaccttagcccctgccgacctctcccagctttcccccactgcccctcacacttgcgaaggcatgagacttggaaccctggccatatgtggctatttaaaagtattaaatcgtgaatgaacaaaaaaaaaaaatctccagcgct

SEQ ID NO: 81622 - DNA, 177 bp, Homo sapiens
tcattgccaatattagagaaaatgacaaggcagcatttatttccaaaggaatagctaggaaaagatggccaaatgtgaaagactagattaaaatcactgttgtctgttatttatttggtaacccatcatgcattttgtttcatcttggggttttttatttagagacaggtctagttc

SEQ ID NO: 81623 - DNA, 353 bp, Homo sapiens
cttttctttcttttcttttttctttctcttttccttccttcctttctttctctctctctttctttcattttttttcagccgtgagtggaatctgggacccttcaaatgccatcctcctttcaattgggccatttgaagacctcgagtttacctcaaacttcatcccttccagcaccagcaaatgcccaaagtcactggccaatgacttatgcttttgttgttttccttccctaacaatctcccttgtgtgacagccaccagcacctccctagggcaagagaccccacgctctgctctcacgtagctgccacctgcagctaatctcagctggcagttggtcgacgtttatgatt

SEQ ID NO: 81624 - DNA, 956 bp, Homo sapiens
cttgttttccattttgattataaccatcctactgagctctttgggttttcatttgcgtttctctaatgattagtgatgttaagcatcttttcatgtgcttattggccatttgtatgtctttgaagaaatgtctgttcaggctttgcccattttttaattgggttgtttgagttgtgagagttttttatgtattctggatattaaatctttctttatcagacatgtgatttgcaaatactttctcccattctgtggcttgtcttttacattttttttattttttttatttttatttattttttttgagacggagttttgctctgttgccgaggctggagtgcagtggtgcaatctcagctcactgcagcctccaagccccaggttcaagtgattctcctgcctcagcccccagagtagctgggattacaggcgcccgccaccttgcccggctaattttttgtatttttagtagagacagtggttcaccattttggtcaggctggtctcaaactcctgatctcaggtgatccacctgcctgggcctcccaaagtgctgggaatataggcatgagccaccgcacctggcctgataatgttctttgatgcacaaaagtttttaatttttatgaagtccaatgtatctgtttttccttttgttgttcttgattttggtatataagaatccacagtcaaatccaaagtaatgaagatttacccttatgttttcttctaagagttttatggctttagctcttacacttagattattgatccattttgagttactttttgtatatagggtgaggtggggattcaacttcattcttttgcatgttggctcttcaattggcccagcactgtttattgaaaagactgttggatggccttcgcactcttgtcaaaaatcaattggccatagatgcttaggttgacttctagactctcagttctattcc

SEQ ID NO: 81625 - DNA, 817 bp, Homo sapiens
agcagaatatgatctgctagtgctcctgttttaccaaaacacagatgattgagagtttaggggattactaaagtctgctctcatcagctctcatttctcagagattcacattctaaattatgcacagtctgatgaaagctcttttgcgtcattgacaaggttgtggcccttctttcagcattacaacttggagattttatgggctgtgttgggaagctcatgatgcacaatgggaggggatgagggatttacattgattaagtttctactctgtgccaggcacttccacacttcacagtatttgattttcctgacccctactctagtattccttccactgtatcatgtttatacagcatcccccttctgtggaaattatcaacacacctaccaaggcaagaggatagtgtggtggtcaagggcttaggctctggattcagatgcacctggtatgctgaatggtctgtttctcctccagacccactctccaaacttctttgtcctactctgcccagggaggctcacctttacagagtagatcagtcaggcttctttgccctctgccttctcattgagtttggtcaataggagccactagcaggagaagaaaagatgtgatgagaaattgctcagcaatgtaatctgtcagttctctttgggccatagtatggcactatcagctttgctctacctaagactacagcttctgccaggcgcagtggctcatgcctgtaatcccaacactttgggaagccaaggagggtggatcacttgagatcaggagcttgagagcagcctggccaacatggcgagatcc

SEQ ID NO: 81626 - DNA, 945 bp, Homo sapiens
agcggagtccactttaaaggggaggaaggcacaaagagaatcgggaaaatagcaataaaccaatggaaacctaatgggggggacttggaagttactatagaaaatagggcatgtgtctgggccctattacacataatcacacttgtaatgccagcactttaggaggctgaaggagagggaatgcttgagtccagaagttcgagaccaccctaggcaacatagcaagaccccatctctacaaaaattagccaggcatggtggtgcactcctgtagtcctaactactcaggaggattgcttgagcccaggaatttgaggctgcagtgagctatgatcataccactgcaatccagactgggtaacagagtgagaccttatctataaaaaaagaaagaaaagaaaagaaagtagggcaagtccatcaagccttttctgccaccagatgtccaccaggacatgttttatggccctatagagtgagaggcaaacagaagcaggtttttgtgcttacaatagaagaacgaggatttggaatgatgtatataggattgttttatagtttaatgagcctctctttcagctttgaggaaataatgacaattgtgtagcgatagtggagaaaagattttttcatgcataagagcaagatgtgaaaaaagatactaactatgctacttctctgcctttgctctctgaaacccatatctccaggcaaaaacccctctcctgaatccatacccacagaaccaggcatgaccagagacttccacctggaggtcacacagcgtgatagaatccataatcatctcactattttcttgctcacccttatggctcttttcctgtgtttcctcccagaaaataccacgattacctagttgtgtaggctggaaacataaaaaccattgctgtctgacctgttcaatcaccacagccagtcaacacc

SEQ ID NO: 81627 - DNA, 335 bp, Homo sapiens
cagcagaactctaccattcaggaaccctgttctcagactttcagccaccagaacagtgagaaaaaatttctgttgtctaaaccacacagtctatggtattttgttatgacagcatgcgctgactaagatagactcaaactgaaacacaggcttttcctgtgtcttaagtctgctggccactggactccagctacatcagctctcctggttttctgaccttcagactcatattggaactatatcagcagggttcagggttctccagggtttcagggttctccagggtcttcagcttgctaactcacccaccttccagatcttgagacttgtcagcc

SEQ ID NO: 81628 - DNA, 414 bp, Homo sapiens
ctaaaggcagcaagacccagtagaatgctgttgaagttatccatgtgtgataggctgggctggagtggtatagtgaagaaaccctgcaaaggataaaatacctgactaaatcaaatatacaaacgaattaagaaatcagttaaaaagctgacttctcagaatattttcttctagaataatataaaatttgatactaaaactacctgtagctgttttacatttttctgcagaatcacagggatattggacttgagcaacaagtgatttaaagttagcgtcttgggccgtgcatgctggctgacacctgtaattccagcactttggggggtgctgaggcaggaagatggcttgagcacaggagtttgagactagcctggccatcatagttgagaccttatctccacaaaaaataaa

SEQ ID NO: 81629 - DNA, 229 bp, Homo sapiens
atagggttgccttaacttcagtatctagccataaaaggaaaggagaaagagaaacgggaggaatactagggaaaagttgctgaaattcttctttgtatacccaagtagtttctctgatgatacttggtttatttaggagaattgccagaaggatttagaaatgtttctagtccttattagtgatggtagttttaatttacttttcttccatgtctctgattcttatcct

SEQ ID NO: 81630 - DNA, 1051 bp, Homo sapiens
tagtagagacagggtttcatcatgttggccaggctggtctcgaactcctgatgatctcaggtgatccacccacctggcctcccaaagtgctgggattacaggtgtgagacaccgcgcccagcccgcagcttcaaatattttgtttgtagttctcttttatcgtgtaaaatctgtggtttataattacccccgagaatgctctcaaattacagttttagcctccatttgttttctcaaatctcctcaatggttcacacactctaggggctctgaaaagaggtgtgtacttttccttttatttatatcctctgcccattttatattaacgtacttaacccttgtttttaatatgagttacagattttttttttttttctggtatgtcatttgtcttttgaccttggtgttttgttatggatttttttttttctcagacttatcttttatggcttctgcattttaagtcatacttagaaaaggcctttccatgttcagattttaaggaatttactaggccaggcatggtagctcacacctatatgttaacactttggaagctgaggtgggggcatcgcttgagctttggagttcaaggctgcagtgagctatgattgctgcactccagcctgatagacagagcgagacctggtctccactccccccaaaaaagactttataaggaattatacttcaatgtttatcttatactttctggtttctttttttttcatttaattctttgttctgtttttctcagcgaactgtatgagatacagatccactgatctttttctagatagctctccagttgtcccaaaatcttttaagtctatttgtaactcactgatagttgtatgctactttttcatatattaaattctcatttgtatatgggcccatttttctggatttttgtattctgtctcttgattcctgcttgttcgtgatccattattctctttctttttttttacagtgtccctagttaatctcacttttttcatatgatcttcagaatcatgttgttttgttccagaagcaaaaaaaaaaa

SEQ ID NO: 81631 - DNA, 461 bp, Homo sapiens
tactactactaaattcgcggccgcgtcgactccagcctgatagacagagcgagacctggtctccactccccccaaaaaagactttataaggaattatacttcaatgtttatcttatactttctggtttctttttttttcatttaattctttgttctgtttttctcagcgaactgtatgagatacagatccactgatctttttctagatagctctccagttgtcccaaaatcttttaagtctatttgtaactcactgatagttgtatgctactttttcatatattaaattctcatttgtatatgggcccatttttctggatttttgtattctgtctcttgattcctgcttgttcgtgatccattattctctttctttttttttacagtgtccctagttaatctcacttttttcatatgatcttcagaatcatgttgttttgttccagaagcaaaaaaaaaaa

SEQ ID NO: 81632 - DNA, 863 bp, Homo sapiens
tgagggaaggacagagtgctagtcagaccacatcaggaggagcttatgtgtcagctgacccacccctggtaggcgatgaccaccagagctctctgtggaaaggcacaggtccccattgtcactaatgagggacctgtgggctgtgcttgtagtctgtcccaacagtgtagcttttgttgttgttgttttgagatagggtcttggctctgttgctctgtccaggctagagtacagtggcacaatcatagctcactccaggctcaaactcctgggctcaggtcatcttcttcctgccttggcctcccaaattgttgggattacaagtgtgagccaccatacctgtccccagcagccacggctttagcagtccttgatgattcatcatggacttgttaaatggtaactggctattattgcactttctacattttagttgtcatttttctatgaaaatgagctcctccctaaaaaaaaaagagttatatattttagttcttattttcttaaatcctcacattgtcccaaatttgaccagtgggagttctattaagttcctttaagttgtatgcctttgacatgtccccgtcagcccttgagcacctctttacgttctggtacaacaagatgttccaggctcatcttgtactgtttttcccaccaccccccccaaccctagcatcagccgtttctcagagaaggcctaggttctttgagtacagaatagtatgtaggagcccaggtctggtcgctggttgtgttcattgctctgggagacagagtttgcaagggaaactctgtgcagtaggtctccaagcagtgctgagcccttgctccaagtggagctcttgggtccatttttgatt

SEQ ID NO: 81633 - DNA, 384 bp, Homo sapiens
gaaactgttgagaactaggaaaagctcaggaatgtttctggtgcataatttgtgatagcaagaacctgaaagtcctccaaaagccgtctacaatgaaatggggaaattaatggtggcacattcctgcataggagatagcagtgataatgggtggataccagaacgtgcatcaacacagaagaatctcagcaacataattcaggattaaaacagcgtttacagctgggcacagtggcccacacctgtaatgccagcactttggaaggccacagtcggcagatggcttgagcccaggagtttgattccaacccgggcaacatactgagaccccatctctactaaaaatacaaaaattagccagtgtggtatcatgtgtctgtggtc

SEQ ID NO: 81634 - DNA, 427 bp, Homo sapiens
  misc_feature (410)..(410): n is a, c, g, or t
cttgtggggaatcacagtaaaccagcaggaagttcacagtgaaaacggtgtggggtgaagaatggtcagattctggattcactttcaagatggagccaaagggacttgctggttaaattgaaagtagaatgtgagagaaagacaagcatcaggaacgtcttccatgctttttgactgagctacacaaatggggtctgaagggctgttgttgtgggaaggttgagggcaaagctagtgggaagaaaaccaggagaggatgaggcaacagaagtccaatgaaggtggggcttcaagggagagttgtgaactcttcccagtgcagctgatggggtaagtggcattaagaactgacatttttatttgatgtagccatgtgggggccatcgtgacattccaaagggggcccctgncacctcacacttaaagt

SEQ ID NO: 81635 - DNA, 1411 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81636 - DNA, 481 bp, Homo sapiens
gaaacacttggaccctggccttgtcttgggctggacaagcttaagcaactctttttgggcctgtggccctgctcccccaaaactaatattttgtaccttgttgcagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81637 - DNA, 609 bp, Homo sapiens
ctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctgggggattgtgccattgcactccgcctg

SEQ ID NO: 81638 - DNA, 1031 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgagactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccgataacaggttcacaaagagatttgtgggcagattgcctcaatctcttacctcttagacttcatttttttaccaggtggagggggg

SEQ ID NO: 81639 - DNA, 662 bp, Homo sapiens
agtgcagaggaggcatggggatgagatcacacacggagccctcacagggaatgagttggggtcatttgatgttcatattagaagctgcaggttctgccttccactggggctgatggcacaagagcactgttacattttacctgctgcctttgagcttgaggttgggtggtaaaccattcttcactgttcttagcggctttatttctcatagagtcatgtgttgcttaacaacggggctacattctgagaaatgcatcattaggtgattgtggtcattgtgggagcatcacagagtgcacctacacagtcctagatggggtagcctactgcacaccaaggctacatggtgtatagcctgttgctcctagaatacaaacctggacagcatggtaccgggctgaatactgtaggcaactgtaacacaatggtaaatgtgtatctgaacatagaaaaggcacagtaaaaatacagtctaaaagattttttaaatagtacacctgtactgggcagttaccataaatggagcttgcaggactggaagctgcactgggtgagtcagcgagtgaatggtgagtgaatgtgaaggcctaggacagcagggactggtttggcaccagggactattttcatgaaagacagtttttccatggacttgcgggcgg

SEQ ID NO: 81640 - DNA, 937 bp, Homo sapiens
aacgggtgacaggaagcgtggtgaggcagccggatgggaaggagaactcctcttctctggcaaaatgtctcagtctgtctcgtttctcccagcagttttgtcatagttacgaatggtgtttcttctctaggagggaaattccttctcatagctatctctgctcatatagatgtctgtaggcaatagggtgggctggcttccagtgtgggtgaagatggacaaggtcagaccaatccagggagcacgtctttcttgcagtggacattgcatctgggatggccattgaagggatgtgctatgcccaggtatgtagcaaccagcccatgcctgcttgttaacataggctgggccaggctagagggactttgtatggtacatgaccatagtgcttctctctgggacttttccctcaaccatctaatgtactggggttcatcctgcccacttaatgccgagaatcacagaacacaggtccttaagaggaagaaccacatcttttgcctctgtatcagatgccactgtaaagttcaggatggagttgggaggtcaagggcttggttgtagcctgcaggctgtgttcaatgtaggggctgtacacttgggactgacctattaaatctcttactcatgggtgagtaaaaaatgctaatctccacgttaacagatatccaaaatactcctaaggggtcctgggacttggagaaactagtgtgaacctggattcaaagccagatttcttactgcaaagaatttttttctctactgagcagcctcatgtcagaccactgcagacggcagctgagttctcaggaggcatgaaagcagtgtgcaagtggaggctaatgctgatggggcacagagaatacaaaggctggcctgtcttccccaggagacaaagcagccacggaggcttatacctttgcatgcctcaagatca

SEQ ID NO: 81641 - DNA, 5124 bp, Homo sapiens
ctgggccctcttctctgccactccctctgcctgcaacaggcttctctcctggactgcccccttccctgcaccttgccaacatgcatgcacacacacaggcactcatgcacacgctcacatatgcacccatgcatgcacacttacatgcacacatgcactcttacatcttttgcctggccaattcctactctcctgtcagctctcagcttaaaggccactgcctcctctgataactcattgctgaccttctatactagggctcccctctgcccactggaggccccttacttgtttgtcctttttctccaagttctcctcacaaatagtaattatttaatgtctgtcttccccactaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaaggtaggaggaaggagaatgggggcctgccaaagccaaggcagatacgtgtcattatgcatctgtgtaaacccacagagtgtacaccaccaagagcgaaccccagtgtacactagggcccccgggtggcgacagtgcatcagtgtaggttcgtcagttgcaacacgtgcctctggtgggggatggggattgcggaaggggctgtgcctgtgtagggccagggagtataggtgaactgtattgaattgtattttccactccatttagctgtgaccctaaaactgctctaagaaaatcatctatttataaacagaataaatattcttctaagacagccaaagcagaaaacgatcaagatcggaagtgtgattaatgtcagcaaaggtttttgctgccacgaggttgaggcaaggagagaaacgtgtcccttggttagtgatgtggctatattcatcactttaatgagaataatgtctgctgagtgatggggctggaacctagattggagaaggtttgagcgaatggaaggtaagaaagtgactaaatgagtatagaaaactaccaagaagcttggctgttgctggtgaaagaatattacacaagtagggccaggattactgtcttgccaaacaggacagaacactaagcctctgtatttagttgctaatttattgtgacagaggagcatattgatctgtccccgtgattgtgcagttagcaaaacccaggctttgagaaaccctgtaggtcaaataccccaggctcctccacagataatctctgagggaaagacagagttgtggggagcatgtgggggttgtaccaggatttaaaagatacacggcaattttagaaattagcaagtctaaactatgatacctaaggatgcacacctgggtgataaaattataaagaaatggccgggtgtggtggctcacacctgtaatcccagcacttttagaggccgaggtgggtggatcacctgaggtcaggagttcgagacaagcctgaccaacatggagaaacctcatctctactaaaaatacaaaattggccgggcgtggtggcacatgctgtaatcccagctactccggaggctgaggcaggagaatcgcttgaacctgggaggcggaggttgtggtgagccaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81642 - DNA, 3303 bp, Homo sapiens
ctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggtaatcgcaactacagcacccgcccaattccaccccatccagggtccttcgctgctttccttttttgccctctgttctgggctctgccctcccacctgaaccctgctcctctgagaagtcttggctgagtcccaggctgagccttctctgggttcccacttcccatgctgattcccaccctgctccctccatcctggtaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81643 - DNA, 4140 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggtaaatgtgcagttccggggcggcgcatgacgcgactgggactaggccggaggcagcgggggaccggcaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81644 - DNA, 3886 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggtaaatgtgcagttccggggcggcgcatgacgcgactgggactaggccggaggcagcgggggaccggcaggtgggccgctcagtgcgttgaaggattcgatccccagtccctccctcccagttctaggcgccccaaaccgctccaggcctgagaggtgggcggcgccttagtggctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81645 - DNA, 3558 bp, Homo sapiens
gggagttgtaaaattaaagaaggtacatgggtgcatgtgtgcttgtgtgtgtgtgtgtctgtctgtctaacaacagcagaagcaggcaagggctactgtggtagtcactgttgttcctctccccattttgcttcacagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81646 - DNA, 3708 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggtaaatgtgcagttccggggcggcgcatgacgcgactgggactaggccggaggcagcgggggaccggcagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81647 - DNA, 3970 bp, Homo sapiens
agtgcagaggaggcatggggatgagatcacacacggagccctcacagggaatgagttggggtcatttgatgttcatattagaagctgcaggttctgccttccactggggctgatggcacaagagcactgttacattttacctgctgcctttgagcttgaggttgggtggtaaaccattcttcactgttcttagcggctttatttctcatagagtcatgtgttgcttaacaacggggctacattctgagaaatgcatcattaggtgattgtggtcattgtgggagcatcacagagtgcacctacacagtcctagatggggtagcctactgcacaccaaggctacatggtgtatagcctgttgctcctagaatacaaacctggacagcatggtaccgggctgaatactgtaggcaactgtaacacaatggtaaatgtgtatctgaacatagaaaaggcacagtaaaaatacagtctaaaagattttttaaatagtacacctgtactgggcagttaccataaatggagcttgcaggactggaagctgcactggtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81648 - DNA, 4418 bp, Homo sapiens
ctgggccctcttctctgccactccctctgcctgcaacaggcttctctcctggactgcccccttccctgcaccttgccaacatgcatgcacacacacaggcactcatgcacacgctcacatatgcacccatgcatgcacacttacatgcacacatgcactcttacatcttttgcctggccaattcctactctcctgtcagctctcagcttaaaggccactgcctcctctgataactcattgctgaccttctatactagggctcccctctgcccactggaggccccttacttgtttgtcctttttctccaagttctcctcacaaatagtaattatttaatgtctgtcttccccactaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaaggtaggaggaaggagaatgggggcctgccaaagccaaggcagatacgtgtcattatgcatctgtgtaaacccacagagtgtacaccaccaagagcgaaccccagtgtacactagggcccccgggtggcgacagtgcatcagtgtaggttcgtcagttgcaacacgtgcctctggtgggggatggggattgcggaaggggctgtgcctgtgtagggccagggagtataggtgaactgtattgaattgtattttccactccatttagctgtgaccctaaaactgctctaagaaaatcatctatttataaacagaataaatattcttctaagacagccaaagcagaaaacgatcaagatcggaagtgtgattaatgtcagcaaaggtttttgctgccacgaggttgaggcaaggagagaaacgtgtcccttggttagtgatgtggctatattcatcactttaatgagaataatgtctgctgagtgatggggctggaacctagattggagaaggtttgagcgaatggaaggtaagaaagtgactaaatgagtatagaaaactaccaagaagcttggctgttgctggtgaaagaatattacacaagtagggccaggattactgtcttgccaaacaggacagaacactaagcctctgtatttagttgctaatttattgtgacagaggagcatattgatctgtccccgtgattgtgcagttagcaaaacccaggctttgagaaaccctgtaggtcaaataccccaggctcctccacagataatctctgagggaaagacagagttgtggggagcatgtgggggttgtaccaggatttaaaagatacacggcaattttagaaattagcaagtctaaactatgatacctaaggatgcacacctgggtgataaaattataaagaaatggccgggtgtggtggctcacacctgtaatcccagcacttttagaggccgaggtgggtggatcacctgaggtcaggagttcgagacaagcctgaccaacatggagaaacctcatctctactaaaaatacaaaattggccgggcgtggtggcacatgctgtaatcccagctactccggaggctgaggcaggagaatcgcttgaacctgggaggcggaggttgtggtgagccaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81649 - DNA, 2932 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81650 - DNA, 2990 bp, Homo sapiens
ctgggccctcttctctgccactccctctgcctgcaacaggcttctctcctggactgcccccttccctgcaccttgccaacatgcatgcacacacacaggcactcatgcacacgctcacatatgcacccatgcatgcacacttacatgcacacatgcactcttacatcttttgcctggccaattcctactctcctgtcagctctcagcttaaaggccactgcctcctctgataactcattgctgaccttctatactagggctcccctctgcccactggaggccccttacttgtttgtcctttttctccaagttctcctcacaaatagtaattatttaatgtctgtcttccccactaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaaggtaggaggaaggagaatgggggcctgccaaagccaaggcagatacgtgtcattatgcatctgtgtaaacccacagagtgtacaccaccaagagcgaaccccagtgtacactagggcccccgggtggcgacagtgcatcagtgtaggttcgtcagttgcaacacgtgcctctggtgggggatggggattgcggaaggggctgtgcctgtgtagggccagggagtataggtgaactgtattgaattgtattttccactccatttagctgtgaccctaaaactgctctaagaaaatcatctatttataaacagaataaatattcttctaagacagccaaagcagaaaacgatcaagatcggaagtgtgattaatgtcagcaaaggtttttgctgccacgaggttgaggcaaggagagaaacgtgtcccttggttagtgatgtggctatattcatcactttaatgagaataatgtctgctgagtgatggggctggaacctagattggagaaggtttgagcgaatggaaggtaagaaagtgactaaatgagtatagaaaactaccaagaagcttggctgttgctggtgaaagaatattacacaagtagggccaggattactgtcttgccaaacaggacagaacactaagcctctgtatttagttgctaatttattgtgacagaggagcatattgatctgtccccgtgattgtgcagttagcaaaacccaggctttgagaaaccctgtaggtcaaataccccaggctcctccacagataatctctgagggaaagacagagttgtggggagcatgtgggggttgtaccaggatttaaaagatacacggcaattttagaaattagcaagtctaaactatgatacctaaggatgcacacctgggtgataaaattataaagaaatggccgggtgtggtggctcacacctgtaatcccagcacttttagaggccgaggtgggtggatcacctgaggtcaggagttcgagacaagcctgaccaacatggagaaacctcatctctactaaaaatacaaaattggccgggcgtggtggcacatgctgtaatcccagctactccggaggctgaggcaggagaatcgcttgaacctgggaggcggaggttgtggtgagccaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81651 - DNA, 1504 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81652 - DNA, 2840 bp, Homo sapiens
ctgggccctcttctctgccactccctctgcctgcaacaggcttctctcctggactgcccccttccctgcaccttgccaacatgcatgcacacacacaggcactcatgcacacgctcacatatgcacccatgcatgcacacttacatgcacacatgcactcttacatcttttgcctggccaattcctactctcctgtcagctctcagcttaaaggccactgcctcctctgataactcattgctgaccttctatactagggctcccctctgcccactggaggccccttacttgtttgtcctttttctccaagttctcctcacaaatagtaattatttaatgtctgtcttccccactaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaaggtaggaggaaggagaatgggggcctgccaaagccaaggcagatacgtgtcattatgcatctgtgtaaacccacagagtgtacaccaccaagagcgaaccccagtgtacactagggcccccgggtggcgacagtgcatcagtgtaggttcgtcagttgcaacacgtgcctctggtgggggatggggattgcggaaggggctgtgcctgtgtagggccagggagtataggtgaactgtattgaattgtattttccactccatttagctgtgaccctaaaactgctctaagaaaatcatctatttataaacagaataaatattcttctaagacagccaaagcagaaaacgatcaagatcggaagtgtgattaatgtcagcaaaggtttttgctgccacgaggttgaggcaaggagagaaacgtgtcccttggttagtgatgtggctatattcatcactttaatgagaataatgtctgctgagtgatggggctggaacctagattggagaaggtttgagcgaatggaaggtaagaaagtgactaaatgagtatagaaaactaccaagaagcttggctgttgctggtgaaagaatattacacaagtagggccaggattactgtcttgccaaacaggacagaacactaagcctctgtatttagttgctaatttattgtgacagaggagcatattgatctgtccccgtgattgtgcagttagcaaaacccaggctttgagaaaccctgtaggtcaaataccccaggctcctccacagataatctctgagggaaagacagagttgtggggagcatgtgggggttgtaccaggatttaaaagatacacggcaattttagaaattagcaagtctaaactatgatacctaaggatgcacacctgggtgataaaattataaagaaatggccgggtgtggtggctcacacctgtaatcccagcacttttagaggccgaggtgggtggatcacctgaggtcaggagttcgagacaagcctgaccaacatggagaaacctcatctctactaaaaatacaaaattggccgggcgtggtggcacatgctgtaatcccagctactccggaggctgaggcaggagaatcgcttgaacctgggaggcggaggttgtggtgagccaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81653 - DNA, 1743 bp, Homo sapiens
agtgcagaggaggcatggggatgagatcacacacggagccctcacagggaatgagttggggtcatttgatgttcatattagaagctgcaggttctgccttccactggggctgatggcacaagagcactgttacattttacctgctgcctttgagcttgaggttgggtggtaaaccattcttcactgttcttagcggctttatttctcatagagtcatgtgttgcttaacaacggggctacattctgagaaatgcatcattaggtgattgtggtcattgtgggagcatcacagagtgcacctacacagtcctagatggggtagcctactgcacaccaaggctacatggtgtatagcctgttgctcctagaatacaaacctggacagcatggtaccgggctgaatactgtaggcaactgtaacacaatggtaaatgtgtatctgaacatagaaaaggcacagtaaaaatacagtctaaaagattttttaaatagtacacctgtactgggcagttaccataaatggagcttgcaggactggaagctgcactggtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81654 - DNA, 1260 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgagactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81655 - DNA, 3255 bp, Homo sapiens
ctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggtaatcgcaactacagcacccgcccaattccaccccatccagggtccttcgctgctttccttttttgccctctgttctgggctctgccctcccacctgaaccctgctcctctgagaagtcttggctgagtcccaggctgagccttctctgggttcccacttcccatgctgattcccaccctgctccctccatcctggtaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81656 - DNA, 3055 bp, Homo sapiens
ctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81657 - DNA, 3628 bp, Homo sapiens
ctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggtaatcgcaactacagcacccgcccaattccaccccatccagggtccttcgctgctttccttttttgccctctgttctgggctctgccctcccacctgaaccctgctcctctgagaagtcttggctgagtcccaggctgagccttctctgggttcccacttcccatgctgattcccaccctgctccctccatcctggtaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctgatctgagtcttggtatcattggctctcagcccctgacctctctcagttatcaggcactcattagagatgtcagaagattttaagatacccctagtttcttcctgtgaacaacagaggtaataaataaactctgacatcggttgaacatgtgtcaggggtcagactgcagatcccagtctctgccagttacttgctgtataaccgtggacaaattgtttaaatgctctgggcctcagcttcctcacctacaaaacaaaacttgtgaagatttagcaaaataaaaacacttcatattcaataaatatgttttaattgttaaattacag

SEQ ID NO: 81658 - DNA, 3633 bp, Homo sapiens
ctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggtaatcgcaactacagcacccgcccaattccaccccatccagggtccttcgctgctttccttttttgccctctgttctgggctctgccctcccacctgaaccctgctcctctgagaagtcttggctgagtcccaggctgagccttctctgggttcccacttcccatgctgattcccaccctgctccctccatcctggtaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctgaaaaacacaaccaaccacacacaagcaaacaacacagaataacaaaacaacgccatcgcccatcgatcacacctccacccagccgccgcgccgcgactgagccctacatacacccaggggcacctcgaagagcacagcagaatacactagaagagaagaacaactaagaagacgacatcaatgaacgagggcgcgcgggtagcctaccgcacgacacacacagagcagcagccgcgacacgacgacagaccgcatgcacacaccagacccgagaccagagcaagacaacgaagcacctcggtgagcacctacatagcgagacacggagaca

SEQ ID NO: 81659 - DNA, 3575 bp, Homo sapiens
ctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggtaatcgcaactacagcacccgcccaattccaccccatccagggtccttcgctgctttccttttttgccctctgttctgggctctgccctcccacctgaaccctgctcctctgagaagtcttggctgagtcccaggctgagccttctctgggttcccacttcccatgctgattcccaccctgctccctccatcctggtaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctgatctgagtcttggtatcattggctctcagcccctgacctctctcagttatcaggcactcattagagatgtcagaagattttaagatacccctagtttcttcctgtgaacaacagaggtaataaataaactctgacatcggttgaacatgtgtcaggggtcagactgcagatcccagtctctgccagttacttgctgtataaccgtggacaaattgtttaaatgctctgggcctcagcttcctcacctacaaaacaaaacttgtgaagatttagcaaaataaaaacacttcatattcaataaatatgttttaattgttaaattacag

SEQ ID NO: 81660 - DNA, 3645 bp, Homo sapiens
ctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggtaatcgcaactacagcacccgcccaattccaccccatccagggtccttcgctgctttccttttttgccctctgttctgggctctgccctcccacctgaaccctgctcctctgagaagtcttggctgagtcccaggctgagccttctctgggttcccacttcccatgctgattcccaccctgctccctccatcctggtaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccaggtatgtagcaaccagcccatgcctgcttgttaacataggctgggccaggctagagggactttgtatggtacatgaccaattttagaaggttcttctcaacacaaacagtctgaccgcatccatcgtccctcataagtcacctggagtggcttgaggagagccatagtgcttctctctgggacttttccctcaaccatctaatgtactggggttcatcctgcccacttaatgccgagaatcacagaacacaggtccttaagaggaagaaccacatcttttgcctctgtatcagatgccactgtaaagttcaggatggagttgggaggtcaagggcttggttgtagcctgcaggctgtgttcaatgtaggggctgtacacttgggactgacctattaaatctcttactcatgggtgagtaaaaaatgctaatctccacgttaacagatatccaaaatactcctaaggggtcctgggacttggagaaactagtgtgaacctggattcaaagccagatttcttactgcaaagaatttttttctctactgagcagcctcatgtcagaccactgcagacggcagctgagttctcaggaggcatgaaagcagtgtgcaagtggaggctaatgctgatggggcacagagaatacaaaggctggcctgtcttccccaggagacaaagcagccacggaggcttatacctttgcatgcctcaagatca

SEQ ID NO: 81661 - DNA, 3544 bp, Homo sapiens
ctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggtaatcgcaactacagcacccgcccaattccaccccatccagggtccttcgctgctttccttttttgccctctgttctgggctctgccctcccacctgaaccctgctcctctgagaagtcttggctgagtcccaggctgagccttctctgggttcccacttcccatgctgattcccaccctgctccctccatcctggtaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtgagagggttttgggttgggacttgggtccactaaagttggtcgcggctgggacacagtgctttcagagctcagacagcacagctgggaaaaactcaggaagtggactcttctaacagacttgaactctgacctcgtgctctacgtcagtttacacatctgcaaattggccagacagtattattgtttacattctatcctcatctttctcccttggagagaggatgagattgaggttaagaaagggtaaatgatttgcccaaggtctcagaggaagtgagtagaaagaacccgggtctgtgtggctgccagtccatgctgcaagatttgtgctggcagtaatgtggcctcagggcagggcttggggtgatgccttgggtgtggctaatccatctgtccacctcaactctcccatctagttaatccatctgtccacctcaactctcccatctagtcactcatcacacactgaatccagaacaaagctgggaactgggatacagatggatgagttaaacatggtcactgcccccgggagggggcagatacagacacaaatcaaggataatggtaccacgctgacaccccagaaaggttagagctttgcggtccattatgatatccatgtgtggcttttaaattaaaagtaaaatgtggtcaggcg

SEQ ID NO: 81662 - DNA, 2590 bp, Homo sapiens
ctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataccttccttagcttcaccctggctagaaataatcacgagggttgggtttgctttggaaaatgcctgtctctctacttgaatgataaagaattaaattagatctctctgatctgagtcttggtatcattggctctcagcccctgacctctctcagttatcaggcactcattagagatgtcagaagattttaagatacccctagtttcttcctgtgaacaacagaggtaataaataaactctgacatcggttgaacatgtgtcaggggtcagactgcagatcccagtctctgccagttacttgctgtataaccgtggacaaattgtttaaatgctctgggcctcagcttcctcacctacaaaacaaaacttgtgaagatttagcaaaataaaaacacttcatattcaataaatatgttttaattgttaaattacag

SEQ ID NO: 81663 - DNA, 3262 bp, Homo sapiens
ctgggccctcttctctgccactccctctgcctgcaacaggcttctctcctggactgcccccttccctgcaccttgccaacatgcatgcacacacacaggcactcatgcacacgctcacatatgcacccatgcatgcacacttacatgcacacatgcactcttacatcttttgcctggccaattcctactctcctgtcagctctcagcttaaaggccactgcctcctctgataactcattgctgaccttctatactagggctcccctctgcccactggaggccccttacttgtttgtcctttttctccaagttctcctcacaaatagtaattatttaatgtctgtcttccccactaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaaggtaggaggaaggagaatgggggcctgccaaagccaaggcagatacgtgtcattatgcatctgtgtaaacccacagagtgtacaccaccaagagcgaaccccagtgtacactagggcccccgggtggcgacagtgcatcagtgtaggttcgtcagttgcaacacgtgcctctggtgggggatggggattgcggaaggggctgtgcctgtgtagggccagggagtataggtgaactgtattgaattgtattttccactccatttagctgtgaccctaaaactgctctaagaaaatcatctatttataaacagaataaatattcttctaagacagccaaagcagaaaacgatcaagatcggaagtgtgattaatgtcagcaaaggtttttgctgccacgaggttgaggcaaggagagaaacgtgtcccttggttagtgatgtggctatattcatcactttaatgagaataatgtctgctgagtgatggggctggaacctagattggagaaggtttgagcgaatggaaggtaagaaagtgactaaatgagtatagaaaactaccaagaagcttggctgttgctggtgaaagaatattacacaagtagggccaggattactgtcttgccaaacaggacagaacactaagcctctgtatttagttgctaatttattgtgacagaggagcatattgatctgtccccgtgattgtgcagttagcaaaacccaggctttgagaaaccctgtaggtcaaataccccaggctcctccacagataatctctgagggaaagacagagttgtggggagcatgtgggggttgtaccaggatttaaaagatacacggcaattttagaaattagcaagtctaaactatgatacctaaggatgcacacctgggtgataaaattataaagaaatggccgggtgtggtggctcacacctgtaatcccagcacttttagaggccgaggtgggtggatcacctgaggtcaggagttcgagacaagcctgaccaacatggagaaacctcatctctactaaaaatacaaaattggccgggcgtggtggcacatgctgtaatcccagctactccggaggctgaggcaggagaatcgcttgaacctgggaggcggaggttgtggtgagccaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctgatctgagtcttggtatcattggctctcagcccctgacctctctcagttatcaggcactcattagagatgtcagaagattttaagatacccctagtttcttcctgtgaacaacagaggtaataaataaactctgacatcggttgaacatgtgtcaggggtcagactgcagatcccagtctctgccagttacttgctgtataaccgtggacaaattgtttaaatgctctgggcctcagcttcctcacctacaaaacaaaacttgtgaagatttagcaaaataaaaacacttcatattcaataaatatgttttaattgttaaattacag

SEQ ID NO: 81664 - DNA, 1228 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggtaaatgtgcagttccggggcggcgcatgacgcgactgggactaggccggaggcagcgggggaccggcaggtgggccgctcagtgcgttgaaggattcgatccccagtccctccctcccagttctaggcgccccaaaccgctccaggcctgagaggtgggcggcgccttagtggctccagactctagctgggggcggggggcctctggcaacctcggtctcttcaaaggccctttggggtcttccgactgtgtggaagggggagcggggtccgcacgggtaggactgggccccgcggcccccaggccaggagcgtttaagtgcgcgttcccctcccccgccaagggtcctggcccggttcgggggcggaggcagcggagccagtcccagtgcccagtgcggcagcgggcagagtgaggagggtgcctctccagccgcgcgcccgccctgggccgctagcgaacctttgcgtccttctggctccagggaaaagttcgctgtttctccgccttttggccaagatcaaggatagtatggagcggggacgaggggtggggggcaaagttcgcgggtcactggcagaaaacgcctctgatcgcgtgttgcgtttttgttgttgttgttgtttgaacttctggagcattcagtggtgctgataacgctcctcagtcctctgctggtaaccatcagggctaggcgcttctcctgccttgggtctcctccccgcatctcatcccctgtctcctgcatttgatacacagatggcattgtactgtacat

SEQ ID NO: 81665 - DNA, 1728 bp, Homo sapiens
ctgggccctcttctctgccactccctctgcctgcaacaggcttctctcctggactgcccccttccctgcaccttgccaacatgcatgcacacacacaggcactcatgcacacgctcacatatgcacccatgcatgcacacttacatgcacacatgcactcttacatcttttgcctggccaattcctactctcctgtcagctctcagcttaaaggccactgcctcctctgataactcattgctgaccttctatactagggctcccctctgcccactggaggccccttacttgtttgtcctttttctccaagttctcctcacaaatagtaattatttaatgtctgtcttccccactaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaaggtaggaggaaggagaatgggggcctgccaaagccaaggcagatacgtgtcattatgcatctgtgtaaacccacagagtgtacaccaccaagagcgaaccccagtgtacactagggcccccgggtggcgacagtgcatcagtgtaggttcgtcagttgcaacacgtgcctctggtgggggatggggattgcggaaggggctgtgcctgtgtagggccagggagtataggtgaactgtattgaattgtattttccactccatttagctgtgaccctaaaactgctctaagaaaatcatctatttataaacagaataaatattcttctaagacagccaaagcagaaaacgatcaagatcggaagtgtgattaatgtcagcaaaggtttttgctgccacgaggttgaggcaaggagagaaacgtgtcccttggttagtgatgtggctatattcatcactttaatgagaataatgtctgctgagtgatggggctggaacctagattggagaaggtttgagcgaatggaaggtaagaaagtgactaaatgagtatagaaaactaccaagaagcttggctgttgctggtgaaagaatattacacaagtagggccaggattactgtcttgccaaacaggacagaacactaagcctctgtatttagttgctaatttattgtgacagaggagcatattgatctgtccccgtgattgtgcagttagcaaaacccaggctttgagaaaccctgtaggtcaaataccccaggctcctccacagataatctctgagggaaagacagagttgtggggagcatgtgggggttgtaccaggatttaaaagatacacggcaattttagaaattagcaagtctaaactatgatacctaaggatgcacacctgggtgataaaattataaagaaatggccgggtgtggtggctcacacctgtaatcccagcacttttagaggccgaggtgggtggatcacctgaggtcaggagttcgagacaagcctgaccaacatggagaaacctcatctctactaaaaatacaaaattggccgggcgtggtggcacatgctgtaatcccagctactccggaggctgaggcaggagaatcgcttgaacctgggaggcggaggttgtggtgagccaaggtaacaagagtgaaactctgtctc

SEQ ID NO: 81666 - DNA, 1022 bp, Homo sapiens
aacgggtgacaggaagcgtggtgaggcagccggatgggaaggagaactcctcttctctggcaaaatgtctcagtctgtctcgtttctcccagcagttttgtcatagttacgaatggtgtttcttctctaggagggaaattccttctcatagctatctctgctcatatagatgtctgtaggcaatagggtgggctggcttccagtgtgggtgaagatggacaaggtcagaccaatccagggagcacgtctttcttgcagtggacattgcatctgggatggccattgaagggatgtgctatgcccaggtatgtagcaaccagcccatgcctgcttgttaacataggctgggccaggctagagggactttgtatggtacatgaccaattttagaaggttcttctcaacacaaacagtctgaccgcatccatcgtccctcataagtcacctggagtggcttgaggagagccatagtgcttctctctgggacttttccctcaaccatctaatgtactggggttcatcctgcccacttaatgccgagaatcacagaacacaggtccttaagaggaagaaccacatcttttgcctctgtatcagatgccactgtaaagttcaggatggagttgggaggtcaagggcttggttgtagcctgcaggctgtgttcaatgtaggggctgtacacttgggactgacctattaaatctcttactcatgggtgagtaaaaaatgctaatctccacgttaacagatatccaaaatactcctaaggggtcctgggacttggagaaactagtgtgaacctggattcaaagccagatttcttactgcaaagaatttttttctctactgagcagcctcatgtcagaccactgcagacggcagctgagttctcaggaggcatgaaagcagtgtgcaagtggaggctaatgctgatggggcacagagaatacaaaggctggcctgtcttccccaggagacaaagcagccacggaggcttatacctttgcatgcctcaagatca

SEQ ID NO: 81667 - DNA, 998 bp, Homo sapiens
  misc_feature (956)..(956): n is a, c, g, or t
  misc_feature (988)..(988): n is a, c, g, or t
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccaattgcccgttcnggctggggcaaaagttagccaatttaacccgnagggaaccgg

SEQ ID NO: 81668 - DNA, 3103 bp, Homo sapiens
ctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81669 - DNA, 5372 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggtaaatgtgcagttccggggcggcgcatgacgcgactgggactaggccggaggcagcgggggaccggcaggtgggccgctcagtgcgttgaaggattcgatccccagtccctccctcccagttctaggcgccccaaaccgctccaggcctgagaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaaggtaggaggaaggagaatgggggcctgccaaagccaaggcagatacgtgtcattatgcatctgtgtaaacccacagagtgtacaccaccaagagcgaaccccagtgtacactagggcccccgggtggcgacagtgcatcagtgtaggttcgtcagttgcaacacgtgcctctggtgggggatggggattgcggaaggggctgtgcctgtgtagggccagggagtataggtgaactgtattgaattgtattttccactccatttagctgtgaccctaaaactgctctaagaaaatcatctatttataaacagaataaatattcttctaagacagccaaagcagaaaacgatcaagatcggaagtgtgattaatgtcagcaaaggtttttgctgccacgaggttgaggcaaggagagaaacgtgtcccttggttagtgatgtggctatattcatcactttaatgagaataatgtctgctgagtgatggggctggaacctagattggagaaggtttgagcgaatggaaggtaagaaagtgactaaatgagtatagaaaactaccaagaagcttggctgttgctggtgaaagaatattacacaagtagggccaggattactgtcttgccaaacaggacagaacactaagcctctgtatttagttgctaatttattgtgacagaggagcatattgatctgtccccgtgattgtgcagttagcaaaacccaggctttgagaaaccctgtaggtcaaataccccaggctcctccacagataatctctgagggaaagacagagttgtggggagcatgtgggggttgtaccaggatttaaaagatacacggcaattttagaaattagcaagtctaaactatgatacctaaggatgcacacctgggtgataaaattataaagaaatggccgggtgtggtggctcacacctgtaatcccagcacttttagaggccgaggtgggtggatcacctgaggtcaggagttcgagacaagcctgaccaacatggagaaacctcatctctactaaaaatacaaaattggccgggcgtggtggcacatgctgtaatcccagctactccggaggctgaggcaggagaatcgcttgaacctgggaggcggaggttgtggtgagccaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81670 - DNA, 4331 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggtaaatgtgcagttccggggcggcgcatgacgcgactgggactaggccggaggcagcgggggaccggcaggtgggccgctcagtgcgttgaaggattcgatccccagtccctccctcccagttctaggcgccccaaaccgctccaggcctgagaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagacaaaattggccgggcgtggtggcacatgctgtaatcccagctactccggaggctgaggcaggagaatcgcttgaacctgggaggcggaggttgtggtgagccaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81671 - DNA, 4176 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagacaaaattggccgggcgtggtggcacatgctgtaatcccagctactccggaggctgaggcaggagaatcgcttgaacctgggaggcggaggttgtggtgagccaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81672 - DNA, 3638 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81673 - DNA, 2839 bp, Homo sapiens
gtcgacagcccatcctcccattcctcttccctggctgattctgtaaccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81674 - DNA, 3434 bp, Homo sapiens
agcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggcgggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggtaaatgtgcagttccggggcggcgcatgacgcgactgggactaggccggaggcagcgggggaccggcaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81675 - DNA, 1628 bp, Homo sapiens
attttgtcaccaagaccactctaacctccctgttcttatgaattcgaacagcatacccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81676 - DNA, 1612 bp, Homo sapiens
ctgggccctcttctctgccactccctctgcctgcaacaggcttctctcctggactgcccccttccctgcaccttgccaacatgcatgcacacacacaggcactcatgcacacgctcacatatgcacccatgcatgcacacttacatgcacacatgcactcttacatcttttgcctggccaattcctactctcctgtcagctctcagcttaaaggccactgcctcctctgataactcattgctgaccttctatactagggctcccctctgcccactggaggccccttacttgtttgtcctttttctccaagttctcctcacaaatagtaattatttaatgtctgtcttccccactaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaagggatcactgagattctgatgaacagaccttctgcccgcaatgccttggggaatgtcttcgtcagtgagctgctggaaactctggcccagctgcgggaggaccggcaagtgcgtgtcctgctcttcagaagtggagtgaagggcgtgttctgtgcaggtgcagacctgaaggagcgggaacagatgagtgaagcagaggtgggggtgtttgtccagcgactccggggcctgatgaatgacatcgcagccttccctgcacccaccattgcggctatggatgggtttgccttgggcggaggcctagagcttgccctggcctgtgacctccgagtggcagcttcctcggcagtcatgggactgattgagaccacgcgagggctcctcccgggggcaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggcccccattgccgtgcggctgggcaaagtagccattgaccgaggaacggaggtggacattgcatctgggatggccattgaagggatgtgctatgcccagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctga

SEQ ID NO: 81677 - DNA, 3897 bp, Homo sapiens
ggcctgtcaccatgtaagaagtgaatttgctcctcgttcgccttctgccatgattgtgaggcctctccagccatgtggaactgtgcagcacttggacagagtcatgaagccagagcgacatttaaaataacatccggagttacatataatcctaatttgcaagacaaactctcagtggatttcaaagttcttgcttttgaccttcagcaaatgatagatgagatctttctatcaagcaatctgaagaatgaatataagaactcaagagttttacaatttgaaaatggcagcattatagtcgtatttgaccttttctttgcccagtgggtgtcagatcaaaatgtaaaagaagaactgattcaaggccttgaagcaaataaatccagccaactggtcactttccatattgatttgaacagcgttgatatcctagcatctttggagaatttttctacagtaagccctgcaacaacttcagacaagctaacaaccaccagtcatctggcaactccaggaaatgtctcaatagagtgcctgcctggttcaagtccttgtactgatgctctaacgtgtataaaagctgatttattttgtgatggagaagtaaactgtccagatggttctgacgaagacaataaaatgtgtgccacagtttgtgatggaagatttttgttaactggatcatctgggtctttccaggctactcattatccaaaaccttctgaaacaagtgttgtctgccagtggatcatacgtgtaaaccaaggactttccattaaactgagcttcgatgattttaatacatattatacagatatattagatatttatgaaggtgtaggatcaagcaagattttaagagcttctatttgggaaactaatcctggcacaataagaattttttccaaccaagttactgccacctttcttatagaatctgatgaaagtgattatgttggctttaatgcaacatatactgcatttaacagcagtgagcttaataattatgagaaaattaattgtaactttgaggatggcttttgtttctgggtccaggatctaaatgatgataatgaatgggaaaggattcagggaagcaccttttctccttttactggacccaattttgaccacacttttggcaatgcttcaggattttacatttctaccccaactggaccaggagggagacaagaacgagtggggcttttaagcctccctttggaccccactttggagccagcttgccttagtttctggtatcatatgtatggtgaaaatgtccataaattaagcattaatatcagcaatgaccaaaatatggagaagacagttttccaaaaggaaggaaattatggagacaattggaattatggacaagtaaccctaaatgaaacagttaaatttaaggttgcttttaatgcttttaaaaacaagatcctgagtgatattgcgttggatgacattagcctaacatatgggatttgcaatgggagtctttatccagaaccaactttggtgccaactcctccaccagaacttcctacggactgtggaggaccttttgagctgtgggagccaaatacaacattcagttctacgaactttccaaacagctaccctaatctggctttctgtgtttggattttaaatgcacaaaaaggaaagaatatacaacttcattttcaagaatttgacttagaaaatattaacgatgtagttgaaataagagatggtgaagaagctgattccttgctcttagctgtgtacacagggcctggcccagtaaaggatgtgttctctaccaccaacagaatgactgtgcttctcatcactaacgatgtgttggcaagaggagggtttaaagcaaactttactactggctatcacttggggattccagagccatgcaaggcagaccattttcaatgtaaaaatggagagtgtgttccactggtgaatctctgtgacggtcatctgcactgtgaggatggctcagatgaagcagattgtgtgcgttttttcaatggcacaacgaacaacaatggtttagtgcggttcagaatccagagcatatggcatacagcttgtgctgagaactggaccacccagatttcaaatgatgtttgtcaactgctgggactagggagtggaaactcatcaaagccaatcttctctaccgatggtggaccatttgtcaaattaaacacagcacctgatggccacttaatactaacacccagtcaacagtgtttacaggattccttgattcggttacagtgtaaccataaatcttgtggaaaaaaactggcagctcaagacatcaccccaaagattgttggaggaagtaatgccaaagaaggggcctggccctgggttgtgggtctgtattatggcggccgactgctctgcggcgcatctctcgtcagcagtgactggctggtgtccgccgcacactgcgtgtatgggagaaacttagagccatccaagtggacagcaatcctaggcctgcatatgaaatcaaatctgacctctcctcaaacagtccctcgattaatagatgaaattgtcataaaccctcattacaataggcgaagaaaggacaacgacattgccatgatgcatctggaatttaaagtgaattacacagattacatacaacctatttgtttaccggaagaaaatcaagtttttcctccaggaagaaattgttctattgctggttgggggacggttgtatatcaaggtactactgcaaacatattgcaagaagctgatgttcctcttctatcaaatgagagatgccaacagcagatgccagaatataacattactgaaaatatgatatgtgcaggctatgaagaaggaggaatagattcttgtcagggggattcaggaggaccattaatgtgccaagaaaacaacaggtggttccttgctggtgtgacctcatttggatacaagtgtgccctgcctaatcgccccggagtgtatgccagggtctcaaggtttaccgaatggatacaaagttttctacattagagcatttcttaaactaaacaggaaagtcgcattattttcccattctactctagaaagcatggaaattaagtgtttcgtacaaaaattttaaaaagttaccaaaggtttttattcttacctatgtcaatgaaatgctagggggccagggaaacaaaattttaaaaataataaaattcaccatagcaatacagaataactttaaaataccattaaatacatttgtatttcattgtgaacaggtatttcttcacagatctcatttttaaaattcttaatgattatttttattacttactgttgtttaaagggatgttattttaaagcatataccatacacttaagaaatttgagcagaatttaaaaaagaaagaaaataaattgtttttcccaaagtatgtcactgttggaaataaactgccataaattttctagttccagtttagtttgctgctattagcagaaactcaattgtttctctgtcttttctatcaaaattttcaacatatgcataaccttagtattttcccaaccaatagaaactatttattgtaagcttatgtcacaggcctggactaaattgattttacgttcctcttaaataagttaattaaataaaagataaattaactgatatagtcattgtatattagataaattttacctatttatttcaagcaagtatttttaagtctcaagaaaataatcagacataccaaagaaatgcacctattgcaaatcctggtcttggtttatgtgtgttacagtggatatttctaatatatgaaaacttatttagacacagctgaatcacccatgagaaggtcaaatatgtgtaataaatgaatttgcttcact

SEQ ID NO: 81678 - DNA, 3955 bp, Homo sapiens
accagacagttcttaaattagcaagccttcaaaaccaaaaatggggtcgaaaagaggcatatcttctaggcatcattctctcagctcctatgaaatcatgtttgcagctctctttgccatattggtagtgctctgtgctggattaattgcagtatcctgcctgacaatcaaggaatcccaacgaggtgcagcacttggacagagtcatgaagccagagcgacatttaaaataacatccggagttacatataatcctaatttgcaagacaaactctcagtggatttcaaagttcttgcttttgaccttcagcaaatgatagatgagatctttctatcaagcaatctgaagaatgaatataagaactcaagagttttacaatttgaaaatggcagcattatagtcgtatttgaccttttctttgcccagtgggtgtcagatcaaaatgtaaaagaagaactgattcaaggccttgaagcaaataaatccagccaactggtcactttccatattgatttgaacagcgttgatatcctagacaagctaacaaccaccagtcatctggcaactccaggaaatgtctcaatagagtgcctgcctggttcaagtccttgtactgatgctctaacgtgtataaaagctgatttattttgtgatggagaagtaaactgtccagatggttctgacgaagacaataaaatgtgtgccacagtttgtgatggaagatttttgttaactggatcatctgggtctttccaggctactcattatccaaaaccttctgaaacaagtgttgtctgccagtggatcatacgtgtaaaccaaggactttccattaaactgagcttcgatgattttaatacatattatacagatatattagatatttatgaaggtgtaggatcaagcaagattttaagagcttctatttgggaaactaatcctggcacaataagaattttttccaaccaagttactgccacctttcttatagaatctgatgaaagtgattatgttggctttaatgcaacatatactgcatttaacagcagtgagcttaataattatgagaaaattaattgtaactttgaggatggcttttgtttctgggtccaggatctaaatgatgataatgaatgggaaaggattcagggaagcaccttttctccttttactggacccaattttgaccacacttttggcaatgcttcaggattttacatttctaccccaactggaccaggagggagacaagaacgagtggggcttttaagcctccctttggaccccactttggagccagcttgccttagtttctggtatcatatgtatggtgaaaatgtccataaattaagcattaatatcagcaatgaccaaaatatggagaagacagttttccaaaaggaaggaaattatggagacaattggaattatggacaagtaaccctaaatgaaacagttaaatttaaggttgcttttaatgcttttaaaaacaagatcctgagtgatattgcgttggatgacattagcctaacatatgggatttgcaatgggagtctttatccagaaccaactttggtgccaactcctccaccagaacttcctacggactgtggaggaccttttgagctgtgggagccaaatacaacattcagttctacgaactttccaaacagctaccctaatctggctttctgtgtttggattttaaatgcacaaaaaggaaagaatatacaacttcattttcaagaatttgacttagaaaatattaacgatgtagttgaaataagagatggtgaagaagctgattccttgctcttagctgtgtacacagggcctggcccagtaaaggatgtgttctctaccaccaacagaatgactgtgcttctcatcactaacgatgtgttggcaagaggagggtttaaagcaaactttactactggctatcacttggggattccagagccatgcaaggcagaccattttcaatgtaaaaatggagagtgtgttccactggtgaatctctgtgacggtcatctgcactgtgaggatggctcagatgaagcagattgtgtgcgttttttcaatggcacaacgaacaacaatggtttagtgcggttcagaatccagagcatatggcatacagcttgtgctgagaactggaccacccagatttcaaatgatgtttgtcaactgctgggactagggagtggaaactcatcaaagccaatcttctctaccgatggtggaccatttgtcaaattaaacacagcacctgatggccacttaatactaacacccagtcaacagtgtttacaggattccttgattcggttacagtgtaaccataaatcttgtggaaaaaaactggcagctcaagacatcaccccaaagattgttggaggaagtaatgccaaagaaggggcctggccctgggttgtgggtctgtattatggcggccgactgctctgcggcgcatctctcgtcagcagtgactggctggtgtccgccgcacactgcgtgtatgggagaaacttagagccatccaagtggacagcaatcctaggcctgcatatgaaatcaaatctgacctctcctcaaacagtccctcgattaatagatgaaattgtcataaaccctcattacaataggcgaagaaaggacaacgacattgccatgatgcatctggaatttaaagtgaattacacagattacatacaacctatttgtttaccggaagaaaatcaagtttttcctccaggaagaaattgttctattgctggttgggggacggttgtatatcaaggtactactgcaaacatattgcaagaagctgatgttcctcttctatcaaatgagagatgccaacagcagatgccagaatataacattactgaaaatatgatatgtgcaggctatgaagaaggaggaatagattcttgtcagggggattcaggaggaccattaatgtgccaagaaaacaacaggtggttccttgctggtgtgacctcatttggatacaagtgtgccctgcctaatcgccccggagtgtatgccagggtctcaaggtttaccgaatggatacaaagttttctacattagagcatttcttaaactaaacaggaaagtcgcattattttcccattctactctagaaagcatggaaattaagtgtttcgtacaaaaattttaaaaagttaccaaaggtttttattcttacctatgtcaatgaaatgctagggggccagggaaacaaaattttaaaaataataaaattcaccatagcaatacagaataactttaaaataccattaaatacatttgtatttcattgtgaacaggtatttcttcacagatctcatttttaaaattcttaatgattatttttattacttactgttgtttaaagggatgttattttaaagcatataccatacacttaagaaatttgagcagaatttaaaaaagaaagaaaataaattgtttttcccaaagtatgtcactgttggaaataaactgccataaattttctagttccagtttagtttgctgctattagcagaaactcaattgtttctctgtcttttctatcaaaattttcaacatatgcataaccttagtattttcccaaccaatagaaactatttattgtaagcttatgtcacaggcctggactaaattgattttacgttcctcttaaataagttaattaaataaaagataaattaactgatatagtcattgtatattagataaattttacctatttatttcaagcaagtatttttaagtctcaagaaaataatcagacataccaaagaaatgcacctattgcaaatcctggtcttggtttatgtgtgttacagtggatatttctaatatatgaaaacttatttagacacagctgaatcacccatgagaaggtcaaatatgtgtaataaatgaatttgcttcact

SEQ ID NO: 81679 - DNA, 444 bp, Homo sapiens
tggatattctacatctactatgtcttccagctattttttctggttgccagttttgatgcttgtcttcttccacagatacttcagatagtataaaaatttcccttactaaaaaagaatgtacttttactgataaaatactccaactcatgttagttaccaagctttagtatattttattccataattcttgtgaagtggtctttctccaacattatcagcagcacaatgcccataaaagtattgactgtttatcccagataaaatcttatgttcacataaaaacctgcacataaatgttcataacagctttatttgtaacagacaaaactggaaacccagatgtccttcaatagatgaatgaaaaaacacaccagtaaacctataccatagaatactacttaaaaaaggaatgaaccattagtacatgcaacaacatgaatgctg

SEQ ID NO: 81680 - DNA, 393 bp, Homo sapiens
gccaaagaatataaatgcaaagctctgagtttctgcgagtatattttaaaagcatctgggctaaatccaattatcataaattatatagttcttttagctaaacatcaagaccatgcttcaggctgggagcagtggctcacacctgtaatcccagcagtttgggaggctgaggtgggcagatcacctgaagtcaggagtttgaaactagcctggccaacatggcgaaacctcgtctctactaaaaatacaaaaattagctgggcatggtggcaggcacctataatcccagttatttgggagactgagtcaggagaatcgcttgaacctgggaggcagaggttgcagtgagccaagatcgtgccactgcactccagcctggtgatagagtgaaac

SEQ ID NO: 81681 - DNA, 133 bp, Homo sapiens
attgcacctaaacccaagaatcactgtttcttatagcggtggtttaaacagaggtgcaaacagcaagcggatcttgtcgcctttggggggctgtggccgtgcccctcaaagtgaatttggaggttccacaact

SEQ ID NO: 81682 - DNA, 1110 bp, Homo sapiens
ggcacgagggtccttagccggtagcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactccca

SEQ ID NO: 81683 - DNA, 494 bp, Homo sapiens
ttcggctaggtacgaggctgggtggtgcccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactccca

SEQ ID NO: 81684 - DNA, 256 bp, Homo sapiens
  misc_feature (55)..(55): n is a, c, g, or t
gcggccgcctactactactactgctcgaattcaagcttctaacgatgtacggggncatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactccca

SEQ ID NO: 81685 - DNA, 1243 bp, Homo sapiens
ggcacgagggtccttagccggtagcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactcccaaggagaaaggacagaggaaggagagagaaagaggagaagaagaagaacaagagaaaaagagaggggaggggcagaaggagacacggagaggacgcagccagagagacaagagagagaggaaagaggggggcga

SEQ ID NO: 81686 - DNA, 1499 bp, Homo sapiens
ggcacgagggtccttagccggtagcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactcccaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaagaccaaacaagacaaacacaacagcacgcaggggggcgggggcgccgcgcacatcccgccgcgcgggggacgccgacatcgcggcgcgcgcgcaaccggtgctcttgacgcgagaacgacggcgacggcggcgcggggagggcagaaaaaagcaacgcgcgcagagaggcagagcggacaggcacagcaccgcgggcggagggggagcaaaagacaccgagcgcacagagacgaggaagagaacacaccacccccccgaggaggagagcgagaatagaggggcaacacaaca

SEQ ID NO: 81687 - DNA, 1111 bp, Homo sapiens
cccaaagtatgtatggggcgagcctggtgttaatcagtcgcgaggctgtacgatggcgataagtcgagctggcgcggcagtatcgattcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactccca

SEQ ID NO: 81688 - DNA, 1547 bp, Homo sapiens
gcagagggccccgttgatcggacgaggggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgtatcctccctcaggctcttccacagcccatacacatgcacttctgcgctttcacacatgcccagacgcccccccgcgccagcccccttttacccatggtaggcagattcccacccaaactggacttaaagagtgaaaatgtgtagctgacattttcccctggcaaatgcagtaccataccctcttgttcttggcagtgatgactgctcggatgtcattaaggtcttagaatttctgccctgaagccaagttccaagttttttaacctaaacccttttgactatttgtatcttccatccttttctgtgtgaggcccagacttgggtaactacctttaattattttctctgcccccctcctgccaggaagtaagggtcatttgtttttgctgcctgattcatccctaaaatatctgtggagaaaggctgaaggaaggcaacagacagagggaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactccca

SEQ ID NO: 81689 - DNA, 1030 bp, Homo sapiens
ggcacgagggtccttagccggtagcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactccca

SEQ ID NO: 81690 - DNA, 1419 bp, Homo sapiens
ggcacgagggtccttagccggtagcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactcccaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaagaccaaacaagacaaacacaacagcacgcaggggggcgggggcgccgcgcacatcccgccgcgcgggggacgccgacatcgcggcgcgcgcgcaaccggtgctcttgacgcgagaacgacggcgacggcggcgcggggagggcagaaaaaagcaacgcgcgcagagaggcagagcggacaggcacagcaccgcgggcggagggggagcaaaagacaccgagcgcacagagacgaggaagagaacacaccacccccccgaggaggagagcgagaatagaggggcaacacaaca

SEQ ID NO: 81691 - DNA, 1098 bp, Homo sapiens
gcagagggccccgttgatcggacgaggggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactccca

SEQ ID NO: 81692 - DNA, 970 bp, Homo sapiens
ggcacgagggtccttagccggtagcttccgggtttcctgggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccagtgacgttcctcatcccgggatcctctagatgaca

SEQ ID NO: 81693 - DNA, 1302 bp, Homo sapiens
gcagagggccccgttgatcggacgaggggctactacgatggcgatgagtttcgagtggccgtggcagtatcgcttcccacccttctttacgtgaggctcagaccccaagaagcaccgctgtgcctccctcccctcccccggaccctgggctcagccctgatgcttcatatggggagggggagaaaagacccgtcggccaacaccctcagtcccttactttcttcctgaaatgcgtcccgggcaagtgctgcctcccgccctctaattctgcgccccactcccttcacccggcaggttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactccca

SEQ ID NO: 81694 - DNA, 1276 bp, Homo sapiens
gcagagggccccgttgatcggacgaggggctactacgatggcgatgagtttcgagtggccgtggcagtatcgcttcccacccttctttacgttacaaccgaatgtggacactcggcagaagcagctggccgcctggtgctcgctggtcctgtccttctgccgcctgcacaaacagtccagcatgacggtgatggaagctcaggagagcccgctcttcaacaacgtcaagctacagcgtatcctccctcaggctcttccacagcccatacacatgcacttctgcgctttcacacatgcccagacgcccccccgcgccagcccccttttacccatgtaagggtcatttgtttttgctgcctgattcatccctaaaatatctgtggagaaaggctgaaggaaggcaacagacagagggaaagcttcctgtggagtcgatccagattgtattagaggaactgaggaagaaagggaacctcgagtggttggataagagcaagtccagcttcctgatcatgtggcggaggccagaagaatgggggaaactcatctatcagtgggtttccaggagtggccagaacaactccgtctttaccctgtatgaactgactaatggggaagacacagaggatgaggagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactccca

SEQ ID NO: 81695 - DNA, 1190 bp, Homo sapiens
tgcactccagcctgggcaacagagcgagatgctatcttaaaaaataacaataggcgtgagccaccgcgcctggcctgtgctcccagctaaaagctagaaaaagggcagataatagtgctggagtttaacagtctcctggccaggggtactggctatattctttgtgttaggatagatcctctagggtcagtgtctagtgacaatggctccgatctccctaggcctgattttcacggcccctttgtggccctgaagcagatggtgtcattctcgtgcatcagacacaaatgctaggtgtgggggaggctgagtctgagaggagaaccaagaagggggaaataagcacaaactcatttcatgctgattcaggctttcttccaccccttactcctaaggagtgcctgggaagtgtggatggcagctgtagcagtatagatggcttatgcataccctgcctctgggaggtctcggcttccagccagagcactctcctcagaggccttgggcctcaggagctgattgtctctgcctatctctccctgttcagagttccacgggctggatgaagccactctactgcgggctctgcaggccctacagcaggagcacaaggccgagatcatcactgtcagcgatggccgaggcgtcaagttcttctagcagggacctgtctccctttacttcttacctcccacctttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatgcgcctgcagcacatgcttctgtctcctcctcctcccacccctttagctgctgttgcctcccttctcaggctggtgctggatccttcctaggggatgggggaagccctggctgcaggcagccttccaggcaatatgaagataggaggcccacgggcctggcagtgagaggtgtggccccacaccgatttatgatattaaaatctcaactccca

SEQ ID NO: 81696 - DNA, 365 bp, Homo sapiens
tgtttgaagaattttttaattttcatattgatttggtttttgccccaatggttattcaggagcagcttatttaatttccatatatttgcgtggctttgaagttttctttgggagttgatgtccagttttattccactgtggtctgagagagtgcttgatatagtttcagttttcttaaatgttttgaggctcgtattatgacctatcatatgatctgtcttggagaaagttccatgtgctgttgaggagaatgtgtgttctgcagttgttgaatgaaatgttttgtatatatctgttaagtccatttttttccaaggtatggtttaaatccactctttctttgtcgactttctgtcttgatggcc

SEQ ID NO: 81697 - DNA, 552 bp, Homo sapiens
agagacagggtttcaccatgttgcccacactggtctcgaactctggacctcaggtgatctgcccacctcagcttcccagtgtgctgggattacaggagtgagccaccgcacccggacttcacagctcagcttctaagcaaatcagatcttttagatttaagtcatttgctttttggttgtccagaaagttgattaattaaagttgatttccttcctgaaggaatattttctgccctcagagagagggcttgtttggtttggtttctgtgccactgtaagcagatgcgtacagccctggcggtgcagaccagcagaggtgttgaaggcacctcttcctcctttgccggctccttattttttgctccattgacctttatggctgtgactggaagaaacaagagatgacactttgaatcagtagatgtctttgtagtttacaggtggttttctattttttttgagacagtctccctctgccgcctagactggtgtgcagtggcgcaatttccggtctctgcaacctctgcctcttgggttcaagtgattctcctg

SEQ ID NO: 81698 - DNA, 769 bp, Homo sapiens
tacaggcatgagccgtcatccctggctggtggtttcttatgacgtgaaacatgcaattaccatatgacctagcagttgcactctgtatttatcccagataaatgaaaacttaccttccaataaaaacctgtgcacaaatgttcatagcagcttaatattgaaaaactggatgttcttcagcaggtgaatgaactggttcattcataccatggaataccattcagcaataaaaaggaacaaactgttgatacatttaaccacctggatgaatatcaagggaattatgctgtcagacaaaaaccagtccctaaagactacatatagtatgattccgtttggataatattcttgaaatagagaaattaagagaaatgaaaagattagtgtttgccagatgttagagacagggaggtgagaggggtaagtgggtgtagttataaaagtgcaacatgagggatctttgtgatgttgaagttgtatcttggcagtggatgcagaaatctcaatgtgataaaattacaaagaactaaaaacaagaatgagtatagataaaactggggaaatctgaacaagttagagtgttgtatcactgtcagtatcttagagtgatattgtactatagctttgcaagatgttaccatgggagaaactaaagtgtacaagggatctctaggtattattatttttttagagatggggtttcactatgttccccaggccggtcttgaactcctgggctctagtgatccgcctgccccagcctcctaaa

SEQ ID NO: 81699 - DNA, 570 bp, Homo sapiens
atgatgggtgcctgtaatcccagctactcgggaggctgagacaggagaattgtttgaacccaggaggtggaggttgcagtgagccgagatcgcaccactgcactccagactgggtgactgagactccatctcaaaaaaaaacaacaacaaaaaacagctcttagaattcttcattagttacaattttgtttcctccgtggcaatatgaattgcaatttgtgaattaaaaacattagaatttgaaaaaattttggctggacatggtagcttatgcctgtaatccctagcactttgggacgccgagcgaggcaggcagatcacctgaggtctggagttcaagaccagcctgaccaacatggtgaaaccccttctctactaaaaaaatacaaaaattagcccagtgtggtggcgcatgcctgtggtcccagctactcaggaggctgaggcaggagaatcgcttgaacccgggaggcagaggttgcagtgagccaagatcatgccactgtactccagcctgggtgacagagtgagactcagtctcaaaaaataaataaataataataaataaaa

SEQ ID NO: 81700 - DNA, 1087 bp, Homo sapiens
agatgctcttccacttatgttgagcttacattctgataaacctattgtaagttgaaaatactgtaggtcgaatattgtaagtgcatttttgattttgcactattgtaaactcagacaaattctaagtccaaccattgctaagttggggaccatttgtaatggtttttaaataatagaagaatgtttcctcagctgtctgtaccattcacaatataatggccacagacacataatacctttaagtttaacctgtcttattaacactctgtacatcactttcttaaatccagacaatcaacaaaatgatcaaaccctgatttgcagcactggccattatccctggtgtaaatattcccattgtggcttatttcaagctaccagtgtgacgtcattgaatgtggagttggggagagatgcatagataccattatatgtgtttcaaccatataggtacaattcatgctaataactagtgtactccatacaattgtaagcttatataatttaattttatgattgcatttcacaagctgctcataaaattcctgaaaatttaatgattagctcttgtgggctggtatgagctgcacccagcacactgctataaatcactgtggccatgtacttcctgctcagtgggtaataaatggcaaagaccccatgccatagttcagatggccttttgtcttcttccttggaagttctttttacactggaggctccttctaagggcatccttcctgtccggataaagcaggactttacctttcttctcttccaaaagcctctcttttttcccttcatagcacatagtcacagttggcagcaacgtctccttttgggtgtggatttatttgttccccaatgcaactgtgagcaccatgagtgcaggaaagtgcctgtttctgatcatggtatttcctgggtgtgacttcatgtacagtcaagaggagaaactctgagtgggagcactagggaatagttgaagcttaatcttcattttggagaagagggagtgttattatccacgttcattattcacagtagcaaatttcacagtagcaaaaaggtgacagacactcaattg

SEQ ID NO: 81701 - DNA, 976 bp, Homo sapiens
tggggctggctccagcatgatgtgggggtctgcaaggccctggagaaagtggggtggtgcagcagggggcacacccacagctggagctgacccagatggacagcttgggctctgccacgcgggactaggcaaggaaggggcacgaacaagcaggaagtggtgaggcggtctccagctagctgctctcccctgcccagactttggtttcctccctgctggcttggcctggctccctggctctgtgtggtatggtcacacccccgtgcaccccctccactgagatggggcggggagagcaccgaggcagcggcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaagcctacttctccctgcaggtgatctcggcgcgcagggccttccgcgtgtcgccgccgctcaccaccggcccacccgagttcgagcgcgtctaccgagcccaggtgaactgcagcgagtacttcccgctgttcctcgccacgctctgggtcgccggcatcttctttcatgaaggggcggcggccctgtgcggcctggtctacctgttcgcgcgcctccgctacttccagggctacgcgcgctccgcgcagctcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgaga

SEQ ID NO: 81702 - DNA, 1223 bp, Homo sapiens
tggggctggctccagcatgatgtgggggtctgcaaggccctggagaaagtggggtggtgcagcagggggcacacccacagctggagctgacccagatggacagcttgggctctgccacgcgggactaggcaaggaaggggcacgaacaagcaggaagtggtgaggcggtctccagctagctgctctcccctgcccagactttggtttcctccctgctggcttggcctggctccctggctctgtgtggtatggtcacacccccgtgcaccccctccactgagatggggcggggagagcaccgaggcagcggcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaagcctacttctccctgcaggtgatctcggcgcgcagggccttccgcgtgtcgccgccgctcaccaccggcccacccgagttcgagcgcgtctaccgagcccagtgaggcgcggcgggagggcgcggggcggggagcgagccccaggcgggtccgggtcgcaggaccatcccggccggcgcgctcatcccacccgcccaccgcagggtgaactgcagcgagtacttcccgctgttcctcgccacgctctgggtcgccggcatcttctttcatgaaggggcggcggccctgtgcggcctggtctacctgttcgcgcgcctccgctacttccagggctacgcgcgctccgcgcagctcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgagacccgggctgcgttctctgggtccgcgggggtggcgcaccgcgggctacggagcctggaggggcccagcccgagtccgggcagcccggggcgggcttcctagtggcggcgtgagagtggctgcgaaggaacgagccctccccctgg

SEQ ID NO: 81703 - DNA, 924 bp, Homo sapiens
tggggctggctccagcatgatgtgggggtctgcaaggccctggagaaagtggggtggtgcagcagggggcacacccacagctggagctgacccagatggacagcttgggctctgccacgcgggactaggcaaggaaggggcacgaacaagcaggaagtggtgaggcggtctccagctagctgctctcccctgcccagactttggtttcctccctgctggcttggcctggctccctggctctgtgtggtatggtcacacccccgtgcaccccctccactgagatggggcggggagagcaccgaggcagcggcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaaggtgggctggttcctatctaggaagagggtgggccttagatccctacagcttgccctctgccccctaggcccaggtggagggcagaggtggggactccagcccaggcccaagctggaagagggtggggactttcagggaactggggggcacctggctgtgagagctgtaggacttgggggtggcaagggtgccaggacaaatggtaggatagccatgggcttggggaagctgatctctgctctttccagctgtcccctctctgggcgtcccagcaagcggcccccattccctggctctgcttcaaaggcacctccatactgggaccacgtggagcagggtagaggtgggactccttcctccagccccctaaaaagagcctgcttaatgcctttctcagactggccctaaaggacacattccttggccagatatccttgccacctaagagacaccactactcc

SEQ ID NO: 81704 - DNA, 1078 bp, Homo sapiens
tggggctggctccagcatgatgtgggggtctgcaaggccctggagaaagtggggtggtgcagcagggggcacacccacagctggagctgacccagatggacagcttgggctctgccacgcgggactaggcaaggaaggggcacgaacaagcaggaagtggtgaggcggtctccagctagctgctctcccctgcccagactttggtttcctccctgctggcttggcctggctccctggctctgtgtggtatggtcacacccccgtgcaccccctccactgagatggggcggggagagcaccgaggcagcggcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaagcctacttctccctgcaggtgatctcggcgcgcagggccttccgcgtgtcgccgccgctcaccaccggcccacccgagttcgagcgcgtctaccgagcccagtgaggcgcggcgggagggcgcggggcggggagcgagccccaggcgggtccgggtcgcaggaccatcccggccggcgcgctcatcccacccgcccaccgcagggtgaactgcagcgagtacttcccgctgttcctcgccacgctctgggtcgccggcatcttctttcatgaaggggcggcggccctgtgcggcctggtctacctgttcgcgcgcctccgctacttccagggctacgcgcgctccgcgcagctcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgaga

SEQ ID NO: 81705 - DNA, 1279 bp, Homo sapiens
  misc_feature (1230)..(1230): n is a, c, g, or t
  misc_feature (1233)..(1233): n is a, c, g, or t
  misc_feature (1235)..(1235): n is a, c, g, or t
  misc_feature (1237)..(1237): n is a, c, g, or t
  misc_feature (1241)..(1242): n is a, c, g, or t
  misc_feature (1257)..(1257): n is a, c, g, or t
  misc_feature (1262)..(1263): n is a, c, g, or t
  misc_feature (1267)..(1267): n is a, c, g, or t
tggggctggctccagcatgatgtgggggtctgcaaggccctggagaaagtggggtggtgcagcagggggcacacccacagctggagctgacccagatggacagcttgggctctgccacgcgggactaggcaaggaaggggcacgaacaagcaggaagtggtgaggcggtctccagctagctgctctcccctgcccagactttggtttcctccctgctggcttggcctggctccctggctctgtgtggtatggtcacacccccgtgcaccccctccactgagatggggcggggagagcaccgaggcagcggcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaagcctacttctccctgcaggtgatctcggcgcgcagggccttccgcgtgtcgccgccgctcaccaccggcccacccgagttcgagcgcgtctaccgagcccaggtgaactgcagcgagtacttcccgctgttcctcgccacgctctgggtcgccggcatcttctttcatgaaggggcggcggccctgtgcggcctggtctacctgttcgcgcgcctccgctacttccagggctacgcgcgctccgcgcagctcaggtgagggccgggcggggagcggggcggggccggggaaagatcgcgggcgggcggggctcctggggagcgggaccgaagctgggggcgggcgacgggccggagcccagcgcctttggggattcggtgggcgagccctggcggcggccagaggaagtccccgtggggccagggttgcggcggggaagaagcgggcctcctcgcgccacctccccgctgaccgccgcccgcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgagaaaaaaaaaaaaaaaaaaaaaaaanaanananaaannaaaaaaaaaaaaaanaaaannaaanaaaaaaaaagaa

SEQ ID NO: 81706 - DNA, 1007 bp, Homo sapiens
tggggctggctccagcatgatgtgggggtctgcaaggccctggagaaagtggggtggtgcagcagggggcacacccacagctggagctgacccagatggacagcttgggctctgccacgcgggactaggcaaggaaggggcacgaacaagcaggaagtggtgaggcggtctccagctagctgctctcccctgcccagactttggtttcctccctgctggcttggcctggctccctggctctgtgtggtatggtcacacccccgtgcaccccctccactgagatggggcggggagagcaccgaggcagcggcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaagcctacttctccctgcaggtgatctcggcgcgcagggccttccgcgtgtcgccgccgctcaccaccggcccacccgagttcgagcgcgtctaccgagcccagtgaggcgcggcgggagggcgcggggcggggagcgagccccaggcgggtccgggtcgcaggaccatcccggccggcgcgctcatcccacccgcccaccgcagggtgaactgcagcgagtacttcccgctgttcctcgccacgctctgggtcgccggcatcttctttcatgaaggggcggcggccctgtgcggcctggtctacctgttcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgaga

SEQ ID NO: 81707 - DNA, 503 bp, Homo sapiens
cagggccttccgcgtgtcgccgccgctcaccaccggcccacccgagttcgagcgcgtctaccgagcccagtgaggcgcggcgggagggcgcggggcggggagcgagccccaggcgggtccgggtcgcaggaccatcccggccggcgcgctcatcccacccgcccaccgcagggtgaactgcagcgagtacttcccgctgttcctcgccacgctctgggtcgccggcatcttctttcatgaaggtcggggtgtggggcaggggcgcacgcgctggacccccgggacccgcgcagggcgctcaccaggcccgtgcgtacctctcgcaggggcggcggccctgtgcggcctggtctacctgttcgcgcgcctccgctacttccagggctacgcgcgctccgcgcagctcaggtgagggccgggcggggagcggggcggggccggggaaagatcgcgggcgggcggggctcctggggagcgggaccgaagctgggggcgggcgacgg

SEQ ID NO: 81708 - DNA, 1049 bp, Homo sapiens
  misc_feature (1000)..(1000): n is a, c, g, or t
  misc_feature (1003)..(1003): n is a, c, g, or t
  misc_feature (1005)..(1005): n is a, c, g, or t
  misc_feature (1007)..(1007): n is a, c, g, or t
  misc_feature (1011)..(1012): n is a, c, g, or t
  misc_feature (1027)..(1027): n is a, c, g, or t
  misc_feature (1032)..(1033): n is a, c, g, or t
  misc_feature (1037)..(1037): n is a, c, g, or t
tggggctggctccagcatgatgtgggggtctgcaaggccctggagaaagtggggtggtgcagcagggggcacacccacagctggagctgacccagatggacagcttgggctctgccacgcgggactaggcaaggaaggggcacgaacaagcaggaagtggtgaggcggtctccagctagctgctctcccctgcccagactttggtttcctccctgctggcttggcctggctccctggctctgtgtggtatggtcacacccccgtgcaccccctccactgagatggggcggggagagcaccgaggcagcggcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaagcctacttctccctgcaggtgatctcggcgcgcagggccttccgcgtgtcgccgccgctcaccaccggcccacccgagttcgagcgcgtctaccgagcccaggtgaactgcagcgagtacttcccgctgttcctcgccacgctctgggtcgccggcatcttctttcatgaaggggcggcggccctgtgcggcctggtctacctgttcgcgcgcctccgctacttccagggctacgcgcgctccgcgcagctcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgagaaaaaaaaaaaaaaaaaaaaaaaanaanananaaannaaaaaaaaaaaaaanaaaannaaanaaaaaaaaagaa

SEQ ID NO: 81709 - DNA, 663 bp, Homo sapiens
ggggcttcgggtgtccagacctgactcccgctccccctcctcccccagcctacttctccctgcaggtgatctcggcgcgcagggccttccgcgtgtcgccgccgctcaccaccggcccacccgagttcgagcgcgtctaccgagcccagtgaggcgcggcgggagggcgcggggcggggagcgagccccaggcgggtccgggtcgcaggaccatcccggccggcgcgctcatcccacccgcccaccgcagggtgaactgcagcgagtacttcccgctgttcctcgccacgctctgggtcgccggcatcttctttcatgaaggggcggcggccctgtgcggcctggtctacctgttcgcgcgcctccgctacttccagggctacgcgcgctccgcgcagctcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgaga

SEQ ID NO: 81710 - DNA, 978 bp, Homo sapiens
  misc_feature (929)..(929): n is a, c, g, or t
  misc_feature (932)..(932): n is a, c, g, or t
  misc_feature (934)..(934): n is a, c, g, or t
  misc_feature (936)..(936): n is a, c, g, or t
  misc_feature (940)..(941): n is a, c, g, or t
  misc_feature (956)..(956): n is a, c, g, or t
  misc_feature (961)..(962): n is a, c, g, or t
  misc_feature (966)..(966): n is a, c, g, or t
tggggctggctccagcatgatgtgggggtctgcaaggccctggagaaagtggggtggtgcagcagggggcacacccacagctggagctgacccagatggacagcttgggctctgccacgcgggactaggcaaggaaggggcacgaacaagcaggaagtggtgaggcggtctccagctagctgctctcccctgcccagactttggtttcctccctgctggcttggcctggctccctggctctgtgtggtatggtcacacccccgtgcaccccctccactgagatggggcggggagagcaccgaggcagcggcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaagcctacttctccctgcaggtgatctcggcgcgcagggccttccgcgtgtcgccgccgctcaccaccggcccacccgagttcgagcgcgtctaccgagcccagggcggcggccctgtgcggcctggtctacctgttcgcgcgcctccgctacttccagggctacgcgcgctccgcgcagctcaggctggcaccgctgtacgcgagcgcgcgcgccctctggctgctggtggcgctggctgcgctcggcctgctcgcccacttcctcccggccgcgctgcgcgccgcgctcctcggacggctccggacgctgctgccgtgggcctgagaccaaggcccccgggccgacggagccgggaaagaagagccggagcctccagctgccccggggaggggcgctcgcttccgcatcctagtctctatcattaaagttctagtgaccgagaaaaaaaaaaaaaaaaaaaaaaaanaanananaaannaaaaaaaaaaaaaanaaaannaaanaaaaaaaaagaa

SEQ ID NO: 81711 - DNA, 432 bp, Homo sapiens
agatcttattcaccatttttgatgtcagtaaagtgtgttacgcaaattggccttcaaaaattaaaacctgtaacaaactttgagtcttgaaatgcatgctatgtatgatcttaaaaacatgtaggtaggcttattagttcatagaggttcatagtatttcatatgtttttcagactatatgtagggaattgctgacaaatcttggtatcactaaatccattatcatgttctgaaatgtcaccaaattgagcctacatattgtgaagagtgagtgtatggccatatagtgtatggcctcaagattttgtcttataatttaagtttcaatgtccacacctcatctaaattagggtaccatttggactatcatgtttaataaatttaccactaagtaattacattaaaaacaaatttatcttaaagatgtataaa

SEQ ID NO: 81712 - DNA, 465 bp, Homo sapiens
tcccaaagtgcagggattacaggcatgagccatcgaacccggcccaagaagaaagacattgaacaagtaattacagggtattgggtgttatgaaagaaaagcatggtactgtataatgaggtcatctaatttagtctggggtgacaaggaatgcctactaaagaaggtatcgtttaagacatacctggggaatagcggtagtgaaaatagaagctccagaaatgcagggaccatggctgacatgtttaccatgccagtgtctggcatggaagaggcccaattcctttggttgaaaggatgaagtaatctagctgaataaagggtgtgtgcgtgcacgcaggtgtgtttgtagttaaccttcctttagctcagcttaggaaacagcttttgtaaaactgcgtaactagtagtaggtgagagaggaatacgaatgatatacacaccattaaagacaacttactaaca

SEQ ID NO: 81713 - DNA, 562 bp, Homo sapiens
aaaatccagcttgaagaagtttagtaacttattcaaagttccaggctagtaagtgatatgagtggctcataagcgaggggctgttagattccaaaagctacaactgagagtaataactaagaaagttttgcaacaagaacttaattaagcagactaaactttttttttttttctttaacttcagagactcagggctgctcctggaaatggtagctcactgagggaaaaacttgtgcaagagggacaaactagtattttctcagaatggcaataagaagggaaaggggccgggtgtggtggctgacgcctgtaatgccagcactttgagaggctgaagtggacggatcacctgaggtcaggagttcgagattagcatggtgaaacctcgtctccactaaaaatacaaaaaaaaattagctgagcttggtggcgggtgcctgtagtcccagctactaggaaggccaaggcgggagaatcacttgaacccaggaggtggagcttgcagtgagccgagatcgcagcactgcactccagcctgggcggcagagcgagattctgtctc

SEQ ID NO: 81714 - DNA, 404 bp, Homo sapiens
aagatatgattaccattttacagatgagaaaacctgagaagaatagaagttaagtagcatgccaagcttacccaactagctctcattcattcattcatgattcatgaagtatttatcaaacaactactatatactgtcattaaagatacaaaaaggatcaaacataatccttgccttcaaagaagccacagtctaaggttaacaagtggactggagcggaatttggttttatcatttcaaaggcaaaggaacccagattggagagttttctggcaactgccttaggactttttggccaagattaatgtaatatataaaggtaagcatcaatgtgttggtgggaagaagtatcctagaaatgttttttgttttttactgtatctaggactcttatgaactactaa

SEQ ID NO: 81715 - DNA, 249 bp, Homo sapiens
gagggcccccaacaccctctgctgggccccacttgccctgtggttcccttccctgctataatcatgttgtcagatagaaacttgggatccgttacctcccatcttgttggacacagaccactgcttcggcctctgtgaccccagatttctcaacatcatttctgaaccttcattgttaagtgtggggaggccaggtatgcagcagacacggttgctgaagaaggatgaatctgcccactatggcagtga

SEQ ID NO: 81716 - DNA, 230 bp, Homo sapiens
ttttggaggataagaggagaaacaggcagactggttaggaggctattgcagtaatccaagtaaaagatgatggtggccgggtatctagtggttgaaatgatgagaactagctggatctaggtaaagccagccagactgttggtatgtataatgaaggaaagaggagtcaaggatgatgccagtgttacatcgcccaaatgagaaagaaagtcatttggcagggagaattt

SEQ ID NO: 81717 - DNA, 394 bp, Homo sapiens
gccagtgtgaaagtgaggaactctgtgatgtgtgagttctggccctttctgcctgcaaggagaggtaagaaccccagtcttgcaaaatactcttccactgccacgcgatcctgtagtgactgctctgctcatgtgtgagaagctctggaaacaatcacaaatagaaatatgaagaaaaacaagacaagtagacactggtgctattaggaaacagtatttcattatgcgagactctatggcattcgcaccacctgagaggaagaatgagacaagttcattaattcttcttttatccttagctgagcactttcgatgtgaagcctaatgagggaaagaaaacaagacttcttccacctagggtatagaatgatggaaaagattttcactcccgtgg

SEQ ID NO: 81718 - DNA, 198 bp, Homo sapiens
  misc_feature (191)..(191): n is a, c, g, or t
  misc_feature (198)..(198): n is a, c, g, or t
ctgtccaaaggcagagttccattgtgacactccagaatgctgtcctttgaaaccatttgaaatgaaagacaggacatagagtgaacatgggatttaggaaagtggaggactatgagaaagacaattttggtcagagtcttattcaagaatggggacttggaagaacatgtggaaataaataccgatgctgnccggagn

SEQ ID NO: 81719 - DNA, 569 bp, Homo sapiens
ctgtccaaaggcagagttccattgtgacactccagaatgctgtcctttgaaaccatttgaaatgaaagacaggacatagagtgaacatgggatttaggaaagtggaggactatgagaaagacaattttggttggtaatttggtatttcactttcttctcatttatacaaatgatatatcaaaaaccataaatgacaataattattaattactgtgacagttgtatagatgttgatggggctcaagaaacaccaccccaaaatatggtaccttggcatttgagaaaacagcaggagcaggaaagccaactctcaccttccccttgcccttctcccttgaagcaggtcataagaccctcattcgagaggtgccctccatatactcaaaggaaaggaacatccttatctttgaagacacagtgccacacagaagaatctgaacaagtaggccttgctaagttcccctcagtttatagacattaaaccacatctcttttgtccaatcatacttttctatgactacccacatcttcatcaaacccaagcataaaaacatatgtttacttatttc

SEQ ID NO: 81720 - DNA, 448 bp, Homo sapiens
ataaaaaggaaaggggcccaagaagaggggtcccagaagagaggtccaagtttcctagagggcaaggacaggccatgattgacaagccagaagtgggctcatgagaactgggctttctctgccaatagttgtgctgtcctgacctaagcttaccttctctaaatgtgtcaatctagaaagagaacagggctttggttttgcaagattaaaaaggtctgcaaattaattgcacacacattgtaataaatctccacccctttttcatcttgcaaattctatgaattttggatgcctcatataagtgaaatcacagtgttagtttttttgtgactgccttatttcgcttagcattatgtcttcaagattcatccatgtagcaagggtcagaatttccttcctttaaaggctgaatgatattccactgtagggatattactatccattcatc

SEQ ID NO: 81721 - DNA, 520 bp, Homo sapiens
ttaaactcccatgtcaggaaattcactcatcattcccttggcagcttttgtttctctgcactgcacaccccacttacagacagccccttcttgccaaagcccagcccagccatgaccatgagttatggcagattgggaatcgttaccttgatcttctcaacccttgggtgtttaccttttccaagttaatgcctgttctttaatgttacattatcttgtagcaaggtagtcatttataatttatatactagagctgccttaaaatagagacaagaggataatcagcatcctgaaacttctagttttccaaaataacatttcttcagtgaagtctgcctgtaggaattaaaacttttggtgaattaaaaagctttttgtcctattgtcagactgggaaatggatgtgcccattactcagccttaaaaacgaggaaggagatcatctgttaaaaataaaactcatcattttcttttattcttctcaaaataatccctaaagacctcaatctttatagtgttc

SEQ ID NO: 81722 - DNA, 665 bp, Homo sapiens
ggcttacacctgtaatcccagtactttgggaggctgaggcgggcagatcaggaggttaggagatcgagaccatcctggctaacatggtgaaaccccgtctctactaaaaatacaaaaaattagccgggcgttgtggcgggtgcctgtagtcccagctactcgggaggctgaggcaggagaatggcgtaaacctgggaggtggagcttgcagtgagccgagattgtgccactgcacgctccagcctgggcaacagagtgaggctccctctaaaaaaaaaaaaaaaaaaaaatacagggtctcatcatctggcccaggctggacttaaactgctgggctcaagtaattcccccacctcagcctcccaagtagctaggactaaaggcatgaaaccaccatgcccggcttgtccaatttcattctacacactttcttggtatttaaacagctgccgttgctcttcattctgtagctctatgtccaattcatgctctagtcctgtatatccaaatgatgactagactgtgctactctgctctctcaaaggcacaccaagcttagcctatgtacaaaactctcccttttccaatccagctttccctcctgcatcacctatctctacatctggaaacaccactcctgcttccctctagcatgtgctaacagt

SEQ ID NO: 81723 - DNA, 415 bp, Homo sapiens
gagatggagtttcgctcttggcacccagactggagtgcaatggcgtgatctcggctccctgcaacctctgctccacaggttcaagcaatctcctgttcagcctccaaagtacctgggactacaggtgcctgccatcatgcccagctaatttttgtatttttagtagagacggggtttcactatgttggccaggcttgtcttaaactcctgacctcaagtgatccgccaacctcggcctcccaaagtgctaggattacaggcctgagccaccgtgcccaaccttttttctttttttagagacaaagcctcccatgatctttcacccaggctggagtataatggcatgatcatagcacactataatctcaaactcctctgtgttcaagcaatcctcccacctcagcctcctgagtag

SEQ ID NO: 81724 - DNA, 412 bp, Homo sapiens
ttgtggttttcttcaggtgtgctgggaggcacaggctaagaggccacagacttccaccacctgagaaagggaacaagccgaacacgctgccgtcaggggtgcaacaaacagaaaaaggagaaaaagctacacaggggagagggaagctggggacttattggtgtggccacaacattaccgaaatagagttaagtcaatgcccatctccagtatttccatctctttcttcacaataaacatgcttcagtcacactttgttccagtcagctagggctgctctacctatagcttgtgaaaatggaaaattgggcttttggtcctctgaatcatctttatccatttttaaatgtccaatcagatgttcttcaaaatggacctgcttcaactttctgtgaacaggaaatgtccagtt

SEQ ID NO: 81725 - DNA, 280 bp, Homo sapiens
gggtaaatctgttaccagttattccataatggctggaagcatacatttcacactattggattattgaggagtttggcaaagacttttgggtgaagttacaggaaagaattacaataaacctttgctgactttagacttgatggctgtttaataattgtatgtttatgggctttgggagtagttgactatgtcttcttcaaatagatgtatgagataatgtaaataataaagcattatacaggctgggcatggtggctcatgtttgcaatcccggcacttt

SEQ ID NO: 81726 - DNA, 773 bp, Homo sapiens
ccatgcctcctccaggggcctctcaacaagtgttctcctttagggctggcatgcatgtgcccaacttgctcactgaacagactaccttggcctgctcagctactcacccttgacaccttcatcaagcactggtgctctgctcagcccagggtcccacagctcctgtgtccacacgtgagtatgcacatgtccgttctcccagcatgtgctgcctgtctgcccaggaggcggctgacagggcaatcctcccaccagggttctggccaggacaaacgaggggcttccccatgatccgggtccctggcagttaacaggctccttgtcttgcctcgatggccccaggagacaatcccaaaaagaccacagttagaaatcaggacgtttcccagggtttagctgccaggtttatccatggccatctgattacatattttaaatcattgcaacggtaaattatccattttaccagcctggtgctggaattcacttttttattgatggaaactctgcagttttacattagttataaggggacttcaaggttgcttatgagaggttttgcccatacaaaaaagtttaggagttatttatgtcccaaaaatgagggactgggatgggctggttgtttcccaaaaatcagtgatttggcttgatttgctattaatcaattttcctcacttcttttgaatttgatcttatctaatgagaagtaaataagtggacaaagttagtgagtcgaatcaagaagcaactggaaaattcccaccaaaatg

SEQ ID NO: 81727 - DNA, 2036 bp, Homo sapiens
ggatctggcagcgccgcgaagacgagcggtcaccggcgcccgacccgagcgcgcccagaggacggcggggagccaagccgacccccgagcagcgccgcgcgggccctgaggctcaaaggggcagcttcaggggaggacaccccactggccaggacgccccaggctctgctgctctgccactcagctgccctcggaggagcgtacacacacaccaggactgcattgccccagctgtgcagcccctgccagatgtgggaggcagctagctgcccagaggcatgcccccctgccagccacagcgacccctgctgctgttgctgctgctgctggcctgccagccacaggtcccctccgctcaggtgatggacttcctgtttgagaagtggaagctctacggtgaccagtgtcaccacaacctgagcctgctgccccctcccacggagctggtgtgcaacagaaccttcgacaagtattcctgctggccggacacccccgccaataccacggccaacatctcctgcccctggtacctgccttggcaccacaaagtgcaacaccgcttcgtgttcaagagatgcgggcccgacggtcagtgggtgcgtggaccccgggggcagccttggcgtgatgcctcccagtgccagatggatggcgaggagattgaggtccagaaggaggtggccaagatgtacagcagcttccaggtgatgtacacagtgggctacagcctgtccctgggggccctgctcctcgccttggccatcctggggggcctcagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgcccccatgctgttcgtcgtcccctgggcagtggtcaagtgtctgttcgagaacgtccagtgctggaccagcaatgacaacatgggcttctggtggatcctgcggttccccgtcttcctggccatcctgatcaacttcttcatcttcgtccgcatcgttcagctgctcgtggccaagctgcgggcacggcagatgcaccacacagactacaagttccggctggccaagtccacgctgaccctcatccctctgctgggcgtccacgaagtggtctttgccttcgtgacggacgagcacgcccagggcaccctgcgctccgccaagctcttcttcgacctcttcctcagctccttccagggcctgctggtggctgtcctctactgcttcctcaacaaggaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctgaaccctgctgggaccccagctagggctggactctggcacccagagggcgtcgctggacaacccagaactggacgcccagctgaggctgggggcgggggagccaacagcagcccccacctaccccccacccccagtgtggctgtctgcgagattgggcctcctctccctgcacctgccttgtccctggtgcagaggtgagcagaggagtccagggcgggagtgggggctgtgccgtgaactgcgtgccagtgtccccacgtatgtcggcacgtcccatgtgcatggaaatgtcctccaacaataaagagctcaagtggtcaccgtg

SEQ ID NO: 81728 - DNA, 2276 bp, Homo sapiens
ggatctggcagcgccgcgaagacgagcggtcaccggcgcccgacccgagcgcgcccagaggacggcggggagccaagccgacccccgagcagcgccgcgcgggccctgaggctcaaaggggcagcttcaggggaggacaccccactggccaggacgccccaggctctgctgctctgccactcagctgccctcggaggagcgtacacacacaccaggactgcattgccccagctgtgcagcccctgccagatgtgggaggcagctagctgcccagaggcatgcccccctgccagccacagcgacccctgctgctgttgctgctgctgctggcctgccagccacaggtcccctccgctcaggtgatggacttcctgtttgagaagtggaagctctacggtgaccagtgtcaccacaacctgagcctgctgccccctcccacgggtgagccccccacccagagcctttcagcctgtgcctggcctcagcacttcctgagttctcttcatgggaaggttcctgggtgcttatgcagcctttgaggaccccgccaaggggccctgtcattcctcaggcccccaccaccgtgggcagagctggtgtgcaacagaaccttcgacaagtattcctgctggccggacacccccgccaataccacggccaacatctcctgcccctggtacctgccttggcaccacaaagtgcaacaccgcttcgtgttcaagagatgcgggcccgacggtcagtgggtgcgtggaccccgggggcagccttggcgtgatgcctcccagtgccagatggatggcgaggagattgaggtccaggtcagtgggcggcaggcaggcgcggtggggctggatgggaacgggcatgggggcccctgcctggccctcacaggccactgtaactcgcagaaggaggtggccaagatgtacagcagcttccaggtgatgtacacagtgggctacagcctgtccctgggggccctgctcctcgccttggccatcctggggggcctcagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgcccccatgctgttcgtcgtcccctgggcagtggtcaagtgtctgttcgagaacgtccagtgctggaccagcaatgacaacatgggcttctggtggatcctgcggttccccgtcttcctggccatcctgatcaacttcttcatcttcgtccgcatcgttcagctgctcgtggccaagctgcgggcacggcagatgcaccacacagactacaagttccggctggccaagtccacgctgaccctcatccctctgctgggcgtccacgaagtggtctttgccttcgtgacggacgagcacgcccagggcaccctgcgctccgccaagctcttcttcgacctcttcctcagctccttccagggcctgctggtggctgtcctctactgcttcctcaacaaggaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctgaaccctgctgggaccccagctagggctggactctggcacccagagggcgtcgctggacaacccagaactggacgcccagctgaggctgggggcgggggagccaacagcagcccccacctaccccccacccccagtgtggctgtctgcgagattgggcctcctctccctgcacctgccttgtccctggtgcagaggtgagcagaggagtccagggcgggagtgggggctgtgccgtgaactgcgtgccagtgtccccacgtatgtcggcacgtcccatgtgcatggaaatgtcctccaacaataaagagctcaagtggtcaccgtg

SEQ ID NO: 81729 - DNA, 248 bp, Homo sapiens
cgccgcagaggacagggaggaggacgggcgctgactggctgtgccacagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagtgagccctctcggcggcctcaggcaggtgggtgggtcggca

SEQ ID NO: 81730 - DNA, 208 bp, Homo sapiens
agaaaacctcaaagcctgggtactgctggggctaagataataaattctcagtaataagatctgcctatttcagcaaaggtctagtgcagtgtttttcaaaccagggactgcaacttgttgatggacattatatcaatttagtgggctacaatgagctttctttcatatcaaggtgggtttcgtgaaacttgttctggggtgtgtgtgt

SEQ ID NO: 81731 - DNA, 336 bp, Homo sapiens
  misc_feature (22)..(22): n is a, c, g, or t
  misc_feature (35)..(35): n is a, c, g, or t
  misc_feature (49)..(49): n is a, c, g, or t
atgttgagcgtgaaattacatngagctgtgaagcntttggtgctgccgnctggaaggagcagcaagtcaagccgccaaggaaacacacattagagtcattcgttctcaccactcggcggaagtggtaactcgctccactggccaggcttcccaccatctggagtggagtccgggtgctcctaccagggatggatgagctccaagtgcaggcagcctggcacaagggccgcggccaccaatgctggaagatagagcctcctgcttcctgcagacagcagagcaatgaggatggcgctttgtgccttttctggttacaaggtgctattgtgaatcact

SEQ ID NO: 81732 - DNA, 828 bp, Homo sapiens
cagagatggatgccattgtaaggagcctggaaatcccaggtgtaggtactgaataaacaagaaagatattgtaataatctcagttttgaggacaagggaaagaaacaaccactgaagaattttgataagaggtttttctagtcttcacaccattttcaggaatatttcagcagggtaggacttagggccacttattcagcctcatgattggccagtttctgtccattcctgcaccttttctcctccttctcttgtgggtagttctctccagttgcctcttctctttgcatatccaggacatgctgataacattagtgtttctgcaaagatattgattttaacagggaaaggagatggggtctggcatatggtagataatcaatgttggttgactaaataaaagccaaacttcatctccactgactttattactacttaaactgaacattaaaaaaaagaattagtcttggacatgatgcaacattattgctgagccaaacttttttactatcttgggttttacagccttcttatccttctggttaagtgagagcaggcaactccatctggcatgtaaagaactggaaaaaatttctatggatttttgtacctgtttatttctccttgtacatgttgtagctactggtagaatatttggatttttgccagtttgttagaagagtaaattttactttacatttactttttatgagcaagattgagcatcttgttatatgtttaagtgtcatttgtgtttctttttaaaataattttttattgttacctctcgcccattcttttctatcaggttgttggtcttttctccac

SEQ ID NO: 81733 - DNA, 228 bp, Homo sapiens
ctgcctgagagtgaagccagaagggaggacagcagagccaagacaggggtgagccaagggtccacagaacatcatttgagtctctggactcagagctagtcctgtagttttcagttataggagccaacatctccttttgtgtttatgccagtttgaactgagtatgggaggagttctaccaagaagttacagctaatccacctgggcttatgaggatcacctgtatcc

SEQ ID NO: 81734 - DNA, 664 bp, Homo sapiens
ccagctcttagtgactctagccctctcccgccctcctctgcaccctgcatgcacttgtgttgctgaatgtggccggagaaaaacacagccatcttgactgttctgtgagacttcatagatttccagggctgtgtggaatcaaaaaatcttcctgcatttccccagccatctggcctccaggatgactatttcacatctcctcaagcctttcacatctcatccccctcacacctgatgattttgcttcctatttcactgggaaaatgaagtagggacggggtttcatcatgttggccaggctggtctcgatcttctgacctcgtgagccgcccacctcggcctcccaaagtgctgggattacaggcatgagccaccgcgcccagccaaagagcctagaaccatgcctggcacacagtgggcatctagaccctttgctgagtggtgaaattgaagtgtgacagggtgcgtggcttccctgctcaggctccctcagttcccaaagctgtgctccttcctggatctcatgtagcacaaggaggcatacgtgggtcgcaccacatggcttctagaggagtatgtgtgaatgtgttcatgttcatgtggaaatagggaggcggccctgaggtgggaggagccttcccaagaggaatcacctgagagagga

SEQ ID NO: 81735 - DNA, 509 bp, Homo sapiens
catggaaaacccaaatggctagaaaaacctcctttagaaaacaggagctttcagatctgcatgcagtgacggtgaaatggtctatttgggtccctaaacagcgtccagcacatcatgaaggttcatcgattgctgctgtgttgcatatttgtaaactcacagtcgtctgactcaccacctgggattctacctgggaggctggcaaggcagatgttaccaccaccattgttctctctaagattaaaaccattttattttgtctctaatacatttctccccaagttgatagatgcagtagtaaccaatagtaaaacagtcatgcatacaattcatcttctcacagagaatcatgactttacaagcacagacttacaatctatcgggaaagaagaaggctgtttttagagagcaagccccttgtaaacctcactttgttataaagtactgttctttgtatatgatgttaaatttgatgtgcttaaattttattaaacatttttatatctgga

SEQ ID NO: 81736 - DNA, 926 bp, Homo sapiens
tgctgtggccctggcacctgcccctgggctgggacagcccactgttccatgctgcccaagaaggctcagcacaggcacaaaccattgcccggcactggcccgtgctgcctgagaaggattggcacgggcacagaccactgcccccacctgccctgcgccatctacccaagaaggctcggcacgggcaccaaccactgcctccaactgccccatgctgcctgagaaggcactgcacggccacccccaactgccccgcactgtccctacccgggcagccatgcgagcggctggaactctgctggccttctgctgcctggtcttgagcaccactgggggcccttccccagatacttgttcccaggaccttaactcacgtgtgaagccaggatttcctaaaacaataaagaccaatgacccaggagtcctccaagcagccagatacagtgttgaaaagttcaacaactgcacgaacgacatgttcttgttcaaggagtcccgcatcacaagggccctagttcagatagtgaaaggcctgaaatatatgctcgaggtggaaattggcagaactacctgcaagaaaaaccagcacctgcgtctggatgactgtgacttccaaaccaaccacaccttgaagcagactctgagctgctactctgaagtctgggtcgtgccctggctccagcacttcgaggtgcctgttctccgttgtcactgacccccgcctcttcagcaagaccacagccatgacaaacaccaggatgcatgctccttgtcccctcccacccgcctcatgacccagcctcacagaccctctcaggcctctgacgagtgagcgggtgaagtgccactgggtcaccgcagggcagctggaatggcagcatggtagcgcctcctaacagattaaatagatcacatttgcttctaaa

SEQ ID NO: 81737 - DNA, 867 bp, Homo sapiens
gccagtgggatgccctggttctgagtccttggggttctctgggaggggacttggaggttgtctctctctagcttggtgatattggggacaacgtaattcccctaaagctgagactaaaacctgaggaatttttcttcaactcctctaagaccacaaatgagaatgaacaaggcggctgccatatccaagtggagaagggctgtccagaaactcaaaactcccgaccccaggaatggagaggggaagcccgcagaccccaggcctgacacagaggccacaagaaacagccatcatggggctggagtgagggctgcagggcgggcccagcagggcatgcaggagacctagtgtgacgtccctcctgagtgcagagctctggccagaaaggagacatctgtctcaggaaggggcacaaacccagcacggggcagggaggggagtgggaggggtctgcaggctctgccgtaagcccgaagcattgccccaagatgctggcccacttcccttctcctcggtgggcacctgcaccactgtcttgaggccctgcttcctagtggagaagcctgccctccctcccctgtgcccagtaacccagtccctttgctccctccagatagtgaaaggcctgaaatatatgctcgaggtggaaattggcagaactacctgcaagaaaaaccagcacctgcgtctggatgactgtgacttccaaaccaaccacaccttgaagcaggtaaagcagcaggcccttctctcagatgtgccctctcttccccagcccactccctcccaggactgtgaaaaacaccgtcaccacgtctctaacgcagcgccccaaacctcacccctgaggaagccaggcctcccaga

SEQ ID NO: 81738 - DNA, 1067 bp, Homo sapiens
tgctgtggccctggcacctgcccctgggctgggacagcccactgttccatgctgcccaagaaggctcagcacaggcacaaaccattgcccggcactggcccgtgctgcctgagaaggattggcacgggcacagaccactgcccccacctgccctgcgccatctacccaagaaggctcggcacgggcaccaaccactgcctccaactgccccatgctgcctgagaaggcactgcacggccacccccaactgccccgcactgtccctacccgggcagccatgcgagcggctggaactctgctggccttctgctgcctggtcttgagcaccactgggggcccttccccagatacttgttcccaggaccttaactcacgtgtgaagccaggatttcctaaaacaataaagaccaatgacccaggagtcctccaagcagccagatacagtgttgaaaagttcaacaactgcacgaacgacatgttcttgttcaaggagtcccgcatcacaagggccctagttcagatagtgaaaggcctgaaatatatgctcgaggtggaaattggcagaactacctgcaagaaaaaccagcacctgcgtctggatgactgtgacttccaaaccaaccacaccttgaagcaggtaaagcagcaggcccttctctcagatgtgccctctcttccccagcccactccctcccaggactgtgaaaaacaccgtcaccacgtctctaacgcagcgccccaaacctcacccctgaggaagccaggcctcccagactcccgcacgactgaggatccgggagaacaggaggtagagcctgtgccaggagctcctcagatgacatcctcccgtcccagaggcggagacacagctctggaagagcgtcctggggtgcgagtggagagggttagagtaagaaaagctttcaaacaatccagaaattatatatgtatcatatacatacatatgatatgtatcatatgtatatcatatatagcatatctctgcagagagagcaagagaacgggaacacagcaacatttagcaattacagaggtgaaaagcacat

SEQ ID NO: 81739 - DNA, 375 bp, Homo sapiens
ccagctccagccagtggaggtaggacaaagcaatagggacttcacccataagggataaatattcctgtgtctctttgttcagtgtgctctcgtggcaggattgctgatgggcagcaccctttctgcagaaagtaaaattgtcttgctgagaaaactttttgtctgaatgctgattcttctttgtagcaccaaggaataagcattcctttccaacagaaatgatgtgtctttttgtatgcttatgaattgactgagggctggcagccccttggtcacttcagtaggggagttggtcacctgaaaaaccaagacaagattagagggttgagactttcagtcccactccaacccacagggttggggagagaggctgaa

SEQ ID NO: 81740 - DNA, 445 bp, Homo sapiens
aaccagcacctcagtgaacagctgttggggctaagaacaattaccgtctctgcagtaagctctaccatgaaataaataatggcacctatggagaaacaacaaaacaaaaataaaaacagagcactaaaaggaaaagcagaattcattcatgctaaagacttaagagaaagtctctgaatgtgattccttttttttttttttaacttttgttttaagttcaggggtacaagtgcagatttgttacataggtcaacttgcgtcatgggaattggttgtatggattatttcatcaccgaggtattaagcctagtacccacgagttgtcttcctgatcctctccctcctcccaccctccaccctccaccctccaaaaggccccagcatgtgttgtttccctctgtatgtccatgtgttctcatcatttacatgattctttacttgaact

SEQ ID NO: 81741 - DNA, 206 bp, Homo sapiens
cagactggtttcaaactcctgacctcaggtgatccaccaggctcagcctcccaaaatgctgcgattacaggcatgagccagtttgcccagactatgctaaattattaatagggtgacagaagacacggttcagtgatcagcctttttttttttttttgctataaaacttttttttttttttttttttttttacacagggtctcact

SEQ ID NO: 81742 - DNA, 374 bp, Homo sapiens
gagacagagtcttgctctgtcacccaggcttaagtgcagtggtgcgatcttggctcactgcaacctccacctcctgggttgaagcaattctcctgcgtcagtctcctgagtggctggaatcacaggtgcctgccatcatgcctggctaatttttgcatttttagtagagacgggatttcatcatggtggccaaactggtttcgaactcttggcctcaagtgatccacccacctcggcctcctaaagtgctgggattacaggtgtgaaccgagccgccatagccggcatcaaccaatggtgatgtaaaacagttattgtaaaatagttatttttctacaattctttctacactcattagttatcatttttctgta

SEQ ID NO: 81743 - DNA, 504 bp, Homo sapiens
ttaaacatagtaggtgtaaaataagtgaccattgattgctgaaaatcaggagtaatacctttatggtaaagtggtagaaaggctgcatacctgctagataaatacagaaatatgcaggttattttctgataatttaggagtgccctctaccttttactacttcactgatcagagctcttctcattctgtgtgagctattaacattcattcctcaggtctcaggtaccttaaaatgtcatttttttttttttttcagcaaaaccagcaaagtgtgggtaggggtatgaataatcaggcctgtgaaattttgttatcttttggggggtcattagtgatctaaatgatcatttctaacctttccaatgaagtgtgaaattctataaagtttaactgttatttttgggcctttatttgtgtatctctgaggagataggaggtggtagtagaataaagaatccttacatttaaaaatacttttcaagaaatgccattaccgtaatcaca

SEQ ID NO: 81744 - DNA, 412 bp, Homo sapiens
attcccttgctggcagcagggaaattaactaccagccacacacttgtctccaacagcacccaccgaccacgtcctgctcccctgtcattaccaccactaaacccggtagcagagagatgagctgtgaggtaggtgccttctagataaatgaggtgctactggacatgcactgtggtcttctctgcagtagaaaaatgtccaaggaaggtcagcatcattgatagaaaataaatgtgaggctgcatctcgccagctcatccatgagcaattccttcagctccagcaggctactgacaatttgcttttaacccaaatccagctctaccctccctaaagcatgcacctagggccccagtcagaaaaacaaaacaaaaactaaaccagacaggataattaaggaggcaaaaagctt

SEQ ID NO: 81745 - DNA, 1031 bp, Homo sapiens
ttactgactacttccccagaccgccctagaggttttatatgtagtgtgtgtatttatatatctttttctaaactcaaaaaatctaaactgaattctgaaacaactctgcccccaggggttgtagatcaaagactgggactacaggcatgcgccaccatgcctggcttatttttgtatttttagtagagacagggtttcactatgttggccaggttggtctcaaactcctgacctcgtgatccgcccacctcagcctcccaaagtgctgggattacaggtgtgagccaccacgcccggccttgcctctcgtctttaaacaataaggttcaaagttccgtgggagcacaaaggagacatgatgaggacaacgggagtagggcctgagtttttttttgtttttttttttttaagcgttttgctcttgttgcctaggctggagtgcaatggcgagatctcagctcactgcaacccctgcctctcaggttcatgtgattctcctgcctcagcctcccgattagctgggcttacaggcacgtgccaccactcccagctaatttttttgtatttttagtagagatggagttataccatgttggccaggctggttttgaactcctgacctcaggtgatccacccgacccggcctcccaaagtgctgggattacaggcatgagccaccacacacggcccaaggcctgagttcttagcaggagtataaggcgcctaagcttagtctaccttctaaggaagcctgcgtttgtcaccatcactcagcaaataacctgaatgtctcctgtctctcagccttaatttttcaggcagcatcatgggacacatacttttagttttgagacaaggccttgctctcacccagggtggagtgcagtggtgcagtcacggcccactgaacttcaaactcctaggctcaagcagctcaagcgatatccgcctcagcctcctgagtagctgagaccacaggcgcgtgccagcatgcctggctagtatttttttacagatggggtcttgctgtg

SEQ ID NO: 81746 - DNA, 682 bp, Homo sapiens
actatgcttattacctgggtgatgaaataatctgtacaccaaacccccatgacatgcaatttacctacataacaaatctgtacacataccccgaacctaaaataaaagttaaaaaaaaaatcttacttgatccctcatggaatctcatatcaacaaaggagaggatcttttataataacaaaatcaggtaacacttttataatttcctttatgtctgtacttattgaaatagttgattgtcagaagatagttttctccttgcaatgattagccatacccttgagaaaaactcctaaaagggtataaaacacagtttggatatgtaaggtttgagatatctattaaactttgatgaggaagtatattggaaatcagtacttggagctagagaaaaggatagatctggagataaatatttgggagtcattaatgtatagatgacatttaaattcaaaggactaaatgaactcacctagggagactgaacagataaagagaagagatagagacctccaacattcagaggccagtcaaacagaggaaagtaggcaaaggagaatgagaaagaataggcagagaggtaggaggaaaatcaggaaagtgtttctaataggaagaagtggtcaagagaatggaataccactgaggtctggtaagatggaaacaaagagatgaccaccgg

SEQ ID NO: 81747 - DNA, 323 bp, Homo sapiens
gtgctaatctctcaatagatttttgttcaaaatgacctttttgattactattagaagacaatgttatcaagagagtagcgtgtaataaaaaatgacaagaaatgactttacctcattataatcaccttagctcagacaaatctttgtaacagtctgtttgcatattacattcactatccttaggagccatttttggaaactgttttagaatccatgagtcaagtcgattcattttgcctgaaatacattaagttatggccaaagttccctaaatgtaatatcagtacttagtgaaagtatgatccaggaaaaattgctgatta

SEQ ID NO: 81748 - DNA, 523 bp, Homo sapiens
ttccagtctgacagtgcttctacttgtggggatgtacctttcttcacttggctcctaatgttggggggaaaggccaacgctgaaaaccccagagcttcaactgacccctacaaaaaggattccacagcttcttaccgtttcaactactgcttcttcatgagaaattccaaacctcaatctctaactatagtttatcttcttattccaaaacgccaaacacctactagacacccacctgtgtacacaagcatctaaaatcatattgctctcatcacaaattaacttctcccaaatttcctgccaattatgctaatattatatccaccattaggtacaaatcttggtcattcaagactccttgcctcatttccatgcttggcttccaaaaccactgtttgagttggacagccttactcctgcttgtgactaccacctagacattgtacctgtaagtctaccctaaaatgacttttatatctgtctagtccaccaatttcttggccgttaagccttcgctgaaact

SEQ ID NO: 81749 - DNA, 328 bp, Homo sapiens
catggtttggaacagcagaaactactccaggaaaggtttagaaaaatgtgtttcctacttgcccccgtcaagtttccaaaaacttggtttgtatcttagaaaccattgcataggatgaaatcccccaccaaactccctcttctctttttctacataggctattgttctgaagataatgattcattcttcctgataccttttggccacctgacggggaagacacaggagagaagggttaagactcttcttgtctccagaatgcttttcaggggcccgtctccaagaggaaactccctatatacacatcagaattcataaagaaagctct

SEQ ID NO: 81750 - DNA, 806 bp, Homo sapiens
cggagcctcgacgccagccgagccccttcgtgtcccagacggcgcctcctcccggggcaacggctaggggtgcaccgaggaagccctgtaccggggctgcgaggaaaggcgtcgaccacagtggaggacgccgaggcttcgcccagaacctcgccggcaccgtcgcgttttctcggtcagctcccaaacgtctgccctcgggtttgccgcccgcgtggcccactcttgcggagggtaggcggcccggcagacgcctctgttccccgaggttctgcgagaggccccagactggcctccgcagcttgtgccttctcgaatgacccggcaggccctgcacttaggattttctgatctctaaaaggggaagctggactgtggctcttggcgttaacaatctcgcaagggaacggcaccggctgagagactcccactttggaactgacttgaggtcccgacgtcccagcaaaaaagtcacttcaattccttctgcatgggggtggggtaggaaatgaaaaaacgggaagcgccaggcggagtccgaggagtccctggagcttccctgggactctggagagccgcgtgtggtccaggaggaggcgggaggactgtggcacccagcatcgctggaggcagaagtgcccaccctggcggagctccggctcaagggagcccaggaggtccagctgcctctctgcgcccaggctctggtgccaccattccttgactcgcccagcctctccccgtgttttcccgtgggagggttggtgctccccgcctttctcatgagctgggtcacgggaggaggg

SEQ ID NO: 81751 - DNA, 146 bp, Homo sapiens
agagcaaaactccatctcaaaaaaataaatacagattttaaacctgtataaataaattcaattcatattacatgccacaaataatatttaaaaatacagctctggtagtaggcctagcttctattccagaaaatggcaggctcttg

SEQ ID NO: 81752 - DNA, 593 bp, Homo sapiens
ctgggaaatcactttgttcctgcctgggagcaggagctgcatgtgtctgggagctgcagtgcggcgctcactcccgggctgcccggccttccctgcaaacctccgtaatcccttcccgcaggtgtttctgcgaggccacgctgggtgacctctgaggtctcctttaggtctgtgctgagacgctttgacgcgacatgggaagcaggcgcaggccacagagtttctagcaatgagcccaaagtgagagtcagtgtgatggggtggctcccggagaaggacacactcttccctgggaacatatttgagaggtaaaagggcaggccccatctccaggcctggcgctggaagagaattccacagaaagcagagaacaacgggcacatccctgtggaaaacaccaacctggcatttcacacacacaatccatgtgttggcattccgtctttagtcactgacaggtcatatgagttggaatctgaggcaagcttctcctgcccctttctcccatttgctccccacacctggtttctcatttagaacaaaggagagaaagtgcagtttcggtgagtggaggagccggcagcatctccagg

SEQ ID NO: 81753 - DNA, 424 bp, Homo sapiens
tgggctattcccctgggtggaagagggatggcagaggaggggagcaggaaagacatgagacatgggggccttgtccttgtactagaggcatcatgcagaaacacaaaacagtcaaccccaaatggaactaaagcacacactaagggtcaatggaagagtgccttcctccctctcaaatgttttgaaactcttctaaaccaacagcattttcttaacatattcaagatcatgtcagtacactagaatccaattatgctggtactacatgcaccatctcttttaaaggatttattacttaattaaaagcctattttattggtaaaatggatcaattttacccaatttactctattgtattaatcacacattcttttccgtaaagatcattttaaaaattaaatattaaaatgctacaattaaaaat

SEQ ID NO: 81754 - DNA, 410 bp, Homo sapiens
cagaagcctagccggcttcacctctcactggcgctcttcgcgggattttgcggcacttaccccgggtgctccagtagcccagaaggagcttgtcccagacaaccaagaggaaaagaggggaagcgagaaagagagggagacccgccattctggccaacgaccctgcgaagagggaatggcggtgcacgcacgggacccagcctctgatcaagcccagcaggcgccggccagctgcgctgagtgctgggcccgtggagcccgcgcccacccggaacctgcgccggcccgcgagcggtgagcgccgggcgcagccccgggttccgcccgcgcctctccctccacacttctccgggagaggagggagccggctccggcctcggccagccccagagagggacccccacagcgca

SEQ ID NO: 81755 - DNA, 132 bp, Homo sapiens
aaagcaggttgcaattacagtgcttcattttgtggaagtactgccattatcctgctgaaagaaaagccgtgttaatcatttttgattttgcctttatgagggtaaaatcatgacagattgacatggacaatt

SEQ ID NO: 81756 - DNA, 396 bp, Homo sapiens
atcaagagttggtaaaaatattaaatcaccaagtcaggaatatctgatggaagaattctaaagcaggccactgggaagaaaaagaaaacaagccctaatacagagttctaaagctgatttgatcttgaggagctaatgccagattcttgcttaaggcttatagaaggtgagagtgcgtaagctatggggtgggaagaggagaatgtttggagaatacattttaaaaccttctataaaacagttcactttaaatctgtctctcagatatttgtatgattaataatcaaatacatatatgtcacaatatattaagaactgggttagaaaccagtatctacctacacactgtttacacttaaaattatgcaggacaaaaataaaacagtgaaaacttag

SEQ ID NO: 81757 - DNA, 327 bp, Homo sapiens
tcttgaactagtggtgagaactagggttcaaaccctggtctcatccactacatgctgcctatctctgccagtggtgttattcagtgtgtttttggctgcacctggcttctgtcctacatcctgccctgcaaggcatgtgactctgtctgacactgctccatatgcccagcacctcgctcttcctggcatctcatagatgttgatgacacaagtgctggcccgaggtgggttcttgtgactgtgtctaatgagctggccgggcacggtggctcatgcactttaaaggaccgaggtgggtggatcacttgaggccaggagtattgagac

SEQ ID NO: 81758 - DNA, 654 bp, Homo sapiens
gtaagaagagccatacgcctcccgccatgattctgagacctccacagcgatgtggaactgtcctgtttctgctgggaggacaatttgagctaactggaaaggggattgtgagaaccattactgggagtacagaaagaaaagcaagaggcagttttgcaatttggagtgagaaccagccccctacacccaaggctaagctcctaccatttcagaaattgagagatgggggtgctatcttccttgatgattgcacttcagagagatggttccaggtcattgaaaaagatattccttgaccttaaagctgtgccgaataatatttcattttctggatatacctcactttatctacttgctacagaagggcatcctgcttactttaaagttttggcaattaggaataaagctgctataagcatccagtcctgcaggttgaaaaatccaagatcatggcactggcaggttttgtgtctgctgagggcctgatcttcacttccaagatggtggctcgagtgctgccttctccaggatacaggaatactgttcctcacatggaagaagtgaaagatcaatgaatccactcttgcaagccaatttttgctctgtttgtttgtttttgagacaaggtctcactctgtcaccctagaggttgga

SEQ ID NO: 81759 - DNA, 915 bp, Homo sapiens
tagttcaggacaggccggtggtaatcggccgaggccagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81760 - DNA, 1332 bp, Homo sapiens
gctcaagtgctcctcccaccttggtctcgaaaagtgctgggattacaggtatgagccaccgagcccggcctttaactgttatttttaatatctgaaattcttgaagatctaaaactgttgtttgtagttattgtttactttttcatagtggttggtttccttgtatttttttcctttttattgtgagctcatgttgctttgaatgtatttttttggaatcctgagggcttaaaatggatatgttctcctccagtgatgattcggtcttgcttctgcaggaatcaggcatattaatgatctgtaaccatttcttttgttccctttactaaagagtggatcctaggtttaattaaggattttcaaattcagactccccatcctgctggagggcctgaggtttattctcctgacactgcatttgctttcaggacaactgtacttttcccatttgctcactttcttttttttcttgctcaggatttagcttattgacctttttctttcagtctgtctttttctgagagagaagggtaggatatgggtagggaatattcttagtgatttcttcaagtaagcccaagcaatgcattaaaaagtatgttccaggttcaagtcatattttaatgagagatcccttaagaatatcttactcttatggtactgctggaagcagaagtgaatgccacactttatacctccaagagttggtgctgtcataggagtatactttaacccaaggatattgctataaatgaagtatttttttatgcttgagagaaactaaaatgttaggaaaatcagggccgctgtgactctcttgaccactgactgggtcggatgagggtgggtcttttctataattgattcagtggaaactaacctgaaattggggtgggttgggggataaacttttacagggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgaggtagacatgtagaacagaggtgccacgcagctaggagggataatcacatgagtattttccctgtgggctactccaatccggtgttaaggtactccctcccttcccactgccagcaaatagcatagagcccttctgcagtacaatattccaaacactctcccatcc

SEQ ID NO: 81761 - DNA, 360 bp, Homo sapiens
tcttacttgaccagagttaggatataccagctcagcagaaagcagttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattagggtatgttggacactaggggccctcagatgtggtattgagctgattaattagagccatgaggagactctgaaggctacttggttttctgtgtccaccacccttaatctctgtgatagaattggcaaataaagcttagacttatggacc

SEQ ID NO: 81762 - DNA, 5323 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81763 - DNA, 5283 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81764 - DNA, 4530 bp, Homo sapiens
gctcaagtgctcctcccaccttggtctcgaaaagtgctgggattacaggtatgagccaccgagcccggcctttaactgttatttttaatatctgaaattcttgaagatctaaaactgttgtttgtagttattgtttactttttcatagtggttggtttccttgtatttttttcctttttattgtgagctcatgttgctttgaatgtatttttttggaatcctgagggcttaaaatggatatgttctcctccagtgatgattcggtcttgcttctgcaggaatcaggcatattaatgatctgtaaccatttcttttgttccctttactaaagagtggatcctaggtttaattaaggattttcaaattcagactccccatcctgctggagggcctgaggtttattctcctgacactgcatttgctttcaggacaactgtacttttcccatttgctcactttcttttttttcttgctcaggatttagcttattgacctttttctttcagtctgtctttttctgagagagaagggtaggatatgggtagggaatattcttagtgatttcttcaagtaagcccaagcaatgcattaaaaagtatgttccaggttcaagtcatattttaatgagagatcccttaagaatatcttactcttatggtactgctggaagcagaagtgaatgccacactttatacctccaagagttggtgctgtcataggagtatactttaacccaaggatattgctataaatgaagtatttttttatgcttgagagaaactaaaatgttaggaaaatcagggccgctgtgactctcttgaccactgactgggtcggatgagggtgggtcttttctataattgattcagtggaaactaacctgaaattggggtgggttgggggataaacttttacagggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81765 - DNA, 5275 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81766 - DNA, 5346 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctggctgtgctgtctccctcctctagtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81767 - DNA, 5224 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81768 - DNA, 5247 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctggctgtgctgtctccctcctctagtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81769 - DNA, 5439 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaaggttagagaggaggacttggagaatgaaggcagagagggcagcactaaaaaaagaaaaaaaaacaagtctgggtgcagtggctcatacctttaatcccagcactttgggaggccaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81770 - DNA, 5629 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggtatagaagcctacagcaccccagatcctgtggtgggtagaaagcagcaggatcaataaacttaattttactaggattcagtaaagggtacaaaagacaggactgtgctttctaccccccaggctgctcctcatttttccctcctcaatctctctcaaaccccagttcatcattttttcttcctccacaggataccccattctgaggaacaaaattgaatttaagcggccagggaaggctgctaacaaggacaactggaataaattccttatggccatcaaggttagagaggaggacttggagaatgaaggcagagagggcagcactaaaaaaagaaaaaaaaacaagtctgggtgcagtggctcatacctttaatcccagcactttgggaggccaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81771 - DNA, 5016 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccgtgaaagtagaagcaaaatagaaagaaaaggctgtgactgcatcccccaatccaaggaggattcgtggctaaaagctggtataca

SEQ ID NO: 81772 - DNA, 1041 bp, Homo sapiens
gagaatccagagcagtttaataataattgttgttttttagttctgtggctgccttacaggatcattggtctggtagctcagtcactttagtgccatattcataatgctttgactttaatcccaggaaaccgtggctgccaggctttctgtttcactcttgcgtcacacccagctactacctgtagacaaagccttctatgaagcaggcattgctgccaaggtgagctgggacaaggaagggtggggcagataggaggaagttaaaggttggaaaatagaatatcccttctgctctggtagaggaaagctgagtgtagggctgatgttacggaggatgtagtcctcctatgtcttcctggatttttctccctggatcccagagaaatagcattcaagcccagcttgctcactcccatttgcatctggatcccagagaagtagcattcaaacccagcttgttcactcccatttgcaactcttctttgctgcaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81773 - DNA, 516 bp, Homo sapiens
agcggccgctcgcgatctagaactagcggacgcgtgggttatgatataaaattgctttgcattgcagaaatgtgaggcccttttggattccactgtttggggctggtctttctttttaaatggtagaatgtatgagacacccatactcatcttttcttctctattattacaaggttgtatcgcaggctctccaccatcccagccaaggtttgttctttcctcattcaagctgctttaagtctgttgctctgaccttttgtatctacctcccatcaactacagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggtgagccgtggccccagaggaggtgttagagggagatgagatttca

SEQ ID NO: 81774 - DNA, 432 bp, Homo sapiens
ttagggcctagttaaatataaaatagcctaaccatacttgtatcaatttttccattttcaggttcgtttagcaaacaccaaaactaataaatcatctaccatctatgggacagagtcttacgtggtgtccctgacaacaaagtgagtaaagaggagtagtatcactagagtctggaagtgttaggaaaatgctgtggggaagtctggactgcaagaccatagtatgaaaggcaggagaactggtagcaggaagcacagacaaggttgtgtttgacagagaaaggggctttcttggtgagataaaatagtctcttcctgtatttctctcctttctccttttttagttgctctgggaaaggaattctctctggtcatgcagatggtaccatcgttaggtatttctttgatgatgaaggctctggagagtcacag

SEQ ID NO: 81775 - DNA, 408 bp, Homo sapiens
caaggaagcaatcgatgctttcatcgagggtgaggagtggaacaaggcgaagcgtgtagctaaggagttagatcccaggtaagcttgtaaccccttcttactgcgaaattctcttttacttccttttgtaaagactgggagaaagtcttaccgggagggttggtattctggaacatgaagatggagctctctgaacatcttcacaggtatgaagactatgtggaccagcattataaagagttcctcaagaatcagggcaaagtggactcggtgagacttggagagttagcaggaggcagaatgcagggagagactcacaagactctctccctcttctttccctcatgtcatctcttttctcttgtaactctgtcttccattgacccagctggtgggtgtggatgtgat

SEQ ID NO: 81776 - DNA, 363 bp, Homo sapiens
tattctggaacatgaagatggagctctctgaacatcttcacaggtatgaagactatgtggaccagcattataaagagttcctcaagaatcagggcaaagtggactcggtgagacttggagagttagcaggaggcagaatgcagggagagactcacaagactctctccctcttctttccctcatgtcatctcttttctcttgtaactctgtcttccattgacccagctggtgggtgtggatgtgatagctgctttggacctgtatgtggagcagggccagtgggacaagtgcattgaaacagctaccaagcaggtactgctctcttcccattcccagtttttctttacattttcccttgattcc

SEQ ID NO: 81777 - DNA, 524 bp, Homo sapiens
gctgatgttacggaggatgtagtcctcctatgtcttcctggatttttctccctggatcccagagaaatagcattcaagcccagcttgctcactcccatttgcatctggatcccagagaagtagcattcaaacccagcttgttcactcccatttgcaactcttctttgctgcaggcagttggctgggataacatggcattcatcttcctcaatcgctttttggacctgaccgatgtgagtagggaagctgtgccccgagggtggaggtttttgccagtcgcgagctgtgcctagttcatggttgcccactctactgcaggcaatcgaggaagggactctagatggccttgaccactctgattttcaggatacagacattccctttgaggtgccactcccagctaagcagcatgtaccggtaagggcacagggttggaaaaccggaaggcctcaccagtgtgagtgccttgaggagggagaatatctttgtgctgccatctttggaaggacctcagccctcactgt

SEQ ID NO: 81778 - DNA, 5522 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacggtaaagttcagaccagtccctggaaccttaggatgaacaaacatatatcagtatatctacttataaatacagccaggagttgcatttctaacatctgaatgtgacttttcctactgcaaggatggtgcttcatggctgttcatggtcatctgctgtcttccttagagccctgctgtgtccttccctataggagattgagagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81779 - DNA, 2800 bp, Homo sapiens
agcggccgctcgcgatctagaactagcggacgcgtgggttatgatataaaattgctttgcattgcagaaatgtgaggcccttttggattccactgtttggggctggtctttctttttaaatggtagaatgtatgagacacccatactcatcttttcttctctattattacaaggttgtatcgcaggctctccaccatcccagccaaggtttgttctttcctcattcaagctgctttaagtctgttgctctgaccttttgtatctacctcccatcaactacagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81780 - DNA, 5495 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggtgagctgggacaaggaagggtggggcagataggaggaagttaaaggttggaaaatagaatatcccttctgctctggtagaggaaagctgagtgtagggctgatgttacggaggatgtagtcctcctatgtcttcctggatttttctccctggatcccagagaaatagcattcaagcccagcttgctcactcccatttgcatctggatcccagagaagtagcattcaaacccagcttgttcactcccatttgcaactcttctttgctgcaggcagttggctgggataacatggcattcatcttcctcaatcgctttttggacctgaccgatgaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81781 - DNA, 5408 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataaaaaacaccaagaaaaaaaaaaaccgggtttttttggggggcaaaaaagaaggggggtattttccgcccctttaaagggaatccgg

SEQ ID NO: 81782 - DNA, 5900 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggtgagctgggacaaggaagggtggggcagataggaggaagttaaaggttggaaaatagaatatcccttctgctctggtagaggaaagctgagtgtagggctgatgttacggaggatgtagtcctcctatgtcttcctggatttttctccctggatcccagagaaatagcattcaagcccagcttgctcactcccatttgcatctggatcccagagaagtagcattcaaacccagcttgttcactcccatttgcaactcttctttgctgcaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggtatagaagcctacagcaccccagatcctgtggtgggtagaaagcagcaggatcaataaacttaattttactaggattcagtaaagggtacaaaagacaggactgtgctttctaccccccaggctgctcctcatttttccctcctcaatctctctcaaaccccagttcatcattttttcttcctccacaggataccccattctgaggaacaaaattgaatttaagcggccagggaaggctgctaacaaggacaactggaataaattccttatggccatcaaggttagagaggaggacttggagaatgaaggcagagagggcagcactaaaaaaagaaaaaaaaacaagtctgggtgcagtggctcatacctttaatcccagcactttgggaggccaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataa

SEQ ID NO: 81783 - DNA, 5147 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggtgagatgtagggggtcgaaggaacactcagtcagaagggctcatctgcaaatgtataaagctgaattgattcacgttctggattcttcagcttgggctcttgaatctccccacctgtctttcagcttctcttctgtctaaacaaatctttagcccttgctgaggttttcttcttccgacctttttagggctctgtgcccacacagcctcagcctcattatgtttaaacatccaaatcccatgatttctttattcacctcttataatgtacacatattctgggcttatttttgactgttcactgtatatttatttcatgtacttggatgatagaattctagaagtggaaagaaccttagaaacaatctaggtgggtgggtgtggtggctcacccctgtaatcccagcactttgggaggccgaggcgggtggatcacttgaggccaggagttcgagaccagcctggccaac

SEQ ID NO: 81784 - DNA, 1857 bp, Homo sapiens
gaaagacaggtgtgcgtcatgcacttgaagcacctgaggaccctgctgagccctcaggatggagctgcaaaggtgacctgcatggcttggtcccagaacaatgccaaatttgctgtctgcacagtggaccgagtggtcttgctgtatgatgaacatggagaacggagagataaattctccaccaaaccagctgacatgaagtatggcaggaagagctatatggtgaagggcatggctttttctcctgattccactaaaattgccataggacagactgacaacatcatctatgtctacaagattggagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattagggtatgttggacactaggggccctcagatgtggtattgagctgattaattagagccatgaggagactctgaaggctacttggttttctgtgtccaccacccttaatctctgtgatagaattggcaaataaagcttagacttatggacc

SEQ ID NO: 81785 - DNA, 535 bp, Homo sapiens
ctgaccttcacctaacttaaaattcctgggatgtagatctttgttctatgggtcatctcttacttgaccagagttaggatataccagctcagcagaaagcaggtcagtaagctttgaaatgcagcatgaacctgagtggtgggttagctcaccacatctcaccattaggaaaatggtcaaaagcaggagacaaccccacatccccttgtaattgtgttacctgccttttctttcttcagttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattagggtatgttggacactaggggccctcagatgtggtattgagctgattaattagagccatgaggagactctgaaggctacttggttttctgtgtccaccacccttaatctctgtgatagaattggcaaata

SEQ ID NO: 81786 - DNA, 6453 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81787 - DNA, 6387 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81788 - DNA, 6405 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81789 - DNA, 6071 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccaccccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81790 - DNA, 5974 bp, Homo sapiens
atcctcctgcctcagcctcccaaatagctgggactacaggtgtgtgccaccacacccagctaattttttttttttttttttttgaaatgagggtctcactctgtcacccaggctggagtgcagtgacatgatctcggctcactagaggtgtcttttttgatattgaacagtgacagtgagctcataaatgtttaggtgttttctgttttgggttctatttatgacccataggtggcacctattgagtgctagatagcaagcaacagcatgtgggcatctggctggctcaggctataggtcctttacttccagtgatgactcaagattgaagtatcattaaacacttaattaacacagtaacttacatattcctctaatatttgctttggccagttaattaaaccatagatgttcctgtatataggcatttactagaattttcatattctttcttgtaggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81791 - DNA, 5686 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgacatgacatgaaatgctgtgtgcccagggtgctgctgggtgccaacagcacctctcactgaatacgatatcactgtgtgcagtcgacg

SEQ ID NO: 81792 - DNA, 5615 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcacctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81793 - DNA, 5206 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccgatgaatagggtgccgatgaatagcgatattcatcggcacctcgctattcatcggcaccggggttggtgtaaaataggcgtaggtagaagtagaggttaaggagggtgatagcgccgatggaatagctattctatcc

SEQ ID NO: 81794 - DNA, 5534 bp, Homo sapiens
tcccatcagcaagccttgacatattctgccatcttttactgctgtctaggcctaggcagtttatgtgaccaaccagagatggatgaatggatgctttcagcaaacatttctgagtactgatgacagcctgtgagcaagacaggcatgcaggttctttagccgtatgaaaagaactgatgtccagggctgtgggagaatggggagaacaggagctgctggactctgtaaagtctctaacctggatgacagtcttctgaattcatatagaaacatccctttttgcaagtggctggtgtcccaaggcgtaatctcatacaacatgaatgggtatgtttaggaaaaggtttgcatgagggaaatggcttgaattcattctctccctcacctctttttaacaatgcagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81795 - DNA, 6399 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81796 - DNA, 5704 bp, Homo sapiens
atcctcctgcctcagcctcccaaatagctgggactacaggtgtgtgccaccacacccagctaattttttttttttttttttttgaaatgagggtctcactctgtcacccaggctggagtgcagtgacatgatctcggctcactagaggtgtcttttttgatattgaacagtgacagtgagctcataaatgtttaggtgttttctgttttgggttctatttatgacccataggtggcacctattgagtgctagatagcaagcaacagcatgtgggcatctggctggctcaggctataggtcctttacttccagtgatgactcaagattgaagtatcattaaacacttaattaacacagtaacttacatattcctctaatatttgctttggccagttaattaaaccatagatgttcctgtatataggcatttactagaattttcatattctttcttgtaggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81797 - DNA, 4371 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagaggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81798 - DNA, 2829 bp, Homo sapiens
cggacgcgtgggcgacccacgcgtccgaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81799 - DNA, 1066 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtaaagtggcttgaataagaatctgtt

SEQ ID NO: 81800 - DNA, 5822 bp, Homo sapiens
cggccgagggcctgctggaggaatgaggaagatacagatccaagggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81801 - DNA, 6371 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81802 - DNA, 5597 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81803 - DNA, 6399 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttattttaaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81804 - DNA, 4955 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaaggatgtttataaaaaaccatttgagcgcgtggtcccgtggtgtggtgtgccccaccctcgaggtggcggcgtgggggtaaaggggtttcctttttaccctgtggggagaactgtgagagctgtgcgggtggccccagtggtctcggtgcccgtgtggacctccccagttctgtgggggcacaaggggggggcccctttttctctc

SEQ ID NO: 81805 - DNA, 5872 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatttgtttgcagttgcctctactagctgatggcagtatgctggaaagaggttgtactataaagagagttctttccttctactccagagttgttgtgtagctttgccattgaaccgatcaatttttaaactctttaaagaagcagcagctatttttttgaaattaaagaaaattctcaggccaggctcaatggctcatgcctataattgtagtgctttgggaggctgagctgggaggatcgcttaagaccagcctaggcaacagagtgagatcctgtctctacaaaaacaaaaattttttttttgttttctttttgagacggagtttcgctcttgttgcccaggctggagtgcaatggtgcggtcttggctcaccgcaacctccgcctcccagattaaagtgattctcctgcctcaacctcctgagtagctgggattgcaggcatgcgccaccatgccgggcgaattttgtatttttaatagagacggggtttctctgtgttggtcaggctggtctcaaactcccaacctcaggtgatccgcccacctcagcctctcagagtgctgggattacagatgtgagccactgcacctggcaaaaaaaaaatttttttttaatttgtcaggtgtggtgatgcatgcatgtagtcccaaatacttaggaggctgaggtggaaggatcacttgagcccaggaggtcaaggcaacagtgagctgtgatcatgccactgcactccagtctgggtgacacagtgagaccctgtctcttaaaaaaaaaaaaagaaagaaaaaaaattattctttaggtaatttcacttggacatattcatgtatatggagtttgtcagctgactcaggcatttaccctaaagatcaaatctgttttcaaaaattggcattggccaggcacggtgacccacacctgtaatcccagcactttgggaggccgaggcgggcggatcacgaggtcaggggttcaagaccagcctggccaacatagtgaaaccccgtctctactaaaaatacaaaaaattagctgggcatggtggtgggcgcctgtaatcccagctacttgagaggctcaggcaggagaatcgcttgaacctgggagtggaggttgcagtgagccgagattgcaccattgtattccaccccgggtgacagtgcaagactccatctcaaaaaaaaaaaaaaaatttggcatcatttacaatttcatagaattactgtgaaggcctttctagttgagatgttggggtatttgggattctaattgttaaccccagaagaaggtaatttagcttgtatttatttaaaacccatttagccttttacttatatctggtagaattccagtgatcatcctaataaggtatatttcagaataatttttttttccttcagaataacttagaatcagatgctataagggctcctaggagcagtgtgaaatttccgtaaagataaatttgaatgttgtaaccaagtttatattaaaccaagaggccatttccaatatgattttttgtttctttttaacttgttaagtccctaagagattacatgctagggcttgagtcatttctattgtagataatgatggcccacacagtcaccttcaactatccacataagctaggctttccgcttttgccacggacagtgtgaccaagatatttccagagtaaataacccaccacaaccttggtaattcctcttttcttcttaagctccaggaagcgaaagcagaaggactcttttcagactgccctctgtagcctacattgcagctttccaaaacaggcagctagcactgggaaagcccatgtggtgaccccatatttttctgaggttcttcttttccatggtgttactttattatcagaaagtaaattcagaaaacaggtcttgcccttagcagacaagaaccacaccagtttcttgtaaaggtaacggatacattgggattcaggagtgacacagaggtccagccccagaacttgtaaggattttgtttgaacactgagcagatgcctcctccctgccacccatcacactagttagggctggccatgaattctatgccagagtcactcctgcagtctgctagggatgggccttcttatcccactctcgcacacatcccagtctagtctttgccttcacagagtcctccttgacacccctgacttaatgatagttgctgttttggagtagaattgatcaggtttaagtcatcctgctcaggttgggcatagtggctcatgcctgtaatctcagcactttgggaagccaaagtgggaggattgcttgagcccaggagttccaaaccatcctgggcaacagagggagaccctgtctctaccaagaaaaaaaaaaaaaaaaaaaagttaaaaaaacaattagctggacctggtggtgcacactcagtaggctgaggtgaaaggattcctttaacctgggagactgaagctgcagtgagccatgatcgtgccactgcactccagtctgggggacaaagtgggaccctatctcaaaaaaaaaaaaaaaaagtcatcctcctccaactactgattgacatatggatcatcagttcagaccctcactgcatacaggatccctagagggttctatttaatagcttgaggaagggagactttaaaaggacgtgtgtgagtgaaataggatatagccattaccacggtgccaggacctgacagcgttccaattctttttgcagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81806 - DNA, 2808 bp, Homo sapiens
ggcacgaggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgagccacatccagatcccgccggggctcacggagctgctgcagggctacacggtggaggtgctgcgacagcagccgcctgacctcgtcgaattcgcagtggagtacttcacccgcctgcgcgaggcccgcgccccagcctcagtcctgcccgccgccaccccacgccagagcctgggccaccccccgccagaacccggcccggaccgtgtcgccgacgccaaaggggacagcgagtcggaggaggacgaggacttggaagttccagttcctagcagatttaatagacgagtatcagtctgtgctgagacctataaccctgatgaggaagaggaagatacagatccaagggtgattcatcctaaaactgatgaacagagatgcagacttcaggaagcttgcaaagatattctccttttcaaaaatcttgatcaggaacagctttctcaagttctcgatgccatgtttgaaaggatagtcaaagctgatgagcatgtcattgaccaaggagatgatggagacaacttttatgtcatagaacggggaacttatgacattttagtaacaaaagataatcaaacccgctctgttggtcaatatgacaaccgtggcagttttggagaactagctctgatgtacaacaccccgagagctgctaccattgttgctacctcagaaggctccctttggggactggaccgggtgacttttagaagaatcatagtgaaaaataatgcaaagaagaggaagatgtttgaatcatttattgagtctgtgcccctccttaaatcactagaggtgtcagaacgaatgaagattgtggatgtaataggagagaagatctataaggatggagaacgcataatcactcagggtgaaaaggctgatagcttttacatcatagagtctggcgaagtgagcatcttgattagaagcaggactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttagttatggatgtacaagcattcgagaggcttctggggccctgcatggacatcatgaagaggaacatctcacactatgaggaacagctggtgaagatgtttggctccagcgtggatctgggcaacctcgggcagtagcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagcttatgccacccactctcttctcttggttgaattctctgaaggaaaggttcatgtgctattgtcctgttagtcaatagtcttcatatataattgtgttacatatattgctgtagactctcagaaatcagggtagagcttttcctttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaacaacaaaaaaaaaaaaggacaagaactgtcactaacctcatggaggggtttgcgtaaaaccatttagcccaccttgagcaaagggtagattccgtgttgtttttttaagctcactgtaataaaatagatctaattcagcattattgtgctacctcaaaggtaaaaaatgttttaaggtcttcttttggtcctgagttctatatacagtgtttgaaatgtctttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatc

SEQ ID NO: 81807 - DNA, 428 bp, Homo sapiens
aaaaggtcactggaattgaaaaactgaagtaacaaatacagtcatgtgtgactatacagattatgcttgtatggagggatgcagtgtttgagcaggtgaaataaaaaagaagacaaaacagatgtacagaggctccatttcttcatatgctatgatttttaatttaaaaaaattactttaaatttatgtttactaatatttatctttttgggtgtacagttctatgaaatttgacaaatgcacagtcttataacccctacaacaagcaagatatagaacagtttgatcaccttccaaaattttctcatgctgtttttttggagtcagtcctgcccccaaccttcaaactcttgcaaactggtaatcattataattttgctttttccagaatgtcatttaattggtaataaagataattctgccttttg

SEQ ID NO: 81808 - DNA, 387 bp, Homo sapiens
ggccttataggacacttcccatcagaagaacacttttatcaaccccctttcctgctcttctgggaggatatatgtgggactctgtggccacctggtggttagaaacagtggaaccactgagacagtgacacacaactccggtgttatctgtaggagtgacttcataagcaccacactgtgacccaaaacacatcgcaggccttggtcatctgaaaagctcctgaattatgggaaatcaagcttcaaaattcagcacactgtgaagaaacaaccacctttagaaacaccagctgggtttatgtataacacttatgaagcatcctcttgtaaatatccaagaaactggacccacctaaccatttcctggtcatttcctaagtcataagc

SEQ ID NO: 81809 - DNA, 286 bp, Homo sapiens
aaaatttgtaaattagttgaccacactgaaaaacaaaaaaactccagatttcaaacttcttttgagaaattcaaatacctggccctgcattcccaaagagcaacaactggctggagctgagtagcagctgccccttatttacacagaactggcactctagttctgccttaagttatatacgaaggaagcagcaaagccaggtttccactcataagccaatgctactgaactcaccaatttttttcttagtaattaaaaaaaagcacacagaaaatataactacaat

SEQ ID NO: 81810 - DNA, 451 bp, Homo sapiens
atctaaatgaatgcactccagtattgatgcctctgatctgttcttagccatcaggggattctaaagaacaggaaagaatgctggctcagatctgtatggaccattgcttagcctctctgagctgtggtttccttatctgttaatctgcagtggtagtgcctaccctgtatgattcttaagatttaatagctcataaataaaaagcacctgctacagtccccaggacagggtaggtccttgtcatagctacatagcttttattggagtctttagtaccccagtttcaggggctttttagataacagataataagttcccttaagaagaatctaagttattttctaatcccttaattaaaaaaaattttttttcagatgactttaaactatgtgtatggatgcacacatgtgtacacacactaatgtggttgtgggctactttgctgatactt

SEQ ID NO: 81811 - DNA, 783 bp, Homo sapiens
cagggggaggcagaaggggactcagatgagttcagctcacaggaagcatctctgaggaaaactgctcagctctgggatccccatctgtccatctgtgcgggctcagttacaagtggacttctccctgcctggggttcaggagactctgctgggtcccttcacccggatgggagaggcacagcagtacctccgccttctgcaaagatctatttgcttcccttcccctctctgccagtttgcacagcactgttggcccagatctcagtgacattctgagccatggaccacctgcaactcagggaggcagttccagtcattgtgctgtgtttgctgagggggtaggggcggggaacaggaaagagaaaaagagtttagaaattgatggagaaataagaaaaaaataccttagcacaaggcagggcaaaaagagtacgaaggttctatagggaacagaagcaggatcaaggaagagaatatggagaaaggacagcaggaaaattaaaggatgggaaggaggtcatctcttctctctttgcacacttgcagatgagaaggggttttgaacagcagtccattccactgtagatttgctctaattatcagaaagttgcttttcaaatgaagtcaaaacctgctctcttggaatttgccagcattggtcatgattctgtcttgtgaattataagagtccatcttatacagtgtttgtagacagttgtcggactgtctcttgcctctccccccattaaaaaagagaaaatctccaggctaaacatctgagac

SEQ ID NO: 81812 - DNA, 804 bp, Homo sapiens
  misc_feature (716)..(717): n is a, c, g, or t
  misc_feature (720)..(720): n is a, c, g, or t
  misc_feature (725)..(726): n is a, c, g, or t
  misc_feature (728)..(728): n is a, c, g, or t
  misc_feature (748)..(748): n is a, c, g, or t
  misc_feature (763)..(764): n is a, c, g, or t
  misc_feature (766)..(767): n is a, c, g, or t
  misc_feature (780)..(780): n is a, c, g, or t
gtcagtcttactcattgtgagagggcatgaactgggaagcaaggattattgggagccattcagagacaagccatgtagttcaccatgacccccagaaatttgtgttccttcctcatgcagaataccctcaccgccaccaaatccccgacagtttggtcccatgacagcatcagtttgaagtccaggctctcatcattgaggtgagatgaggctcctggggtccagttcttcaagtataggtcctctcagtctgaagatctgagaactagagagagaggctatctgctcccttccacaaacccaatgcacagtgggacagccataggataaccattacagacatgcccatccaaaaagggagaaacagggagcgtacaagagtcgctgatccattccagttccgaaatccgctagggtttatggtggcatttcctcaattgggactcaaagcctgggagtgatttctgtcttggttctgccctctgagttctccttccttttctgtgaaaagtagcctgtattttcagtgtagtcgttttctcagcctgcttcctcctttttattttatattacctttgacttttttgttttttgtttttgagatagaggcttgctccatcacccaggctattgtgcaatggcgtgatctcggctcactgcaacctccgcctcctgggttcaagcaattctgcctcagcctcttgagtagctgaggnnganggatnncntgaggtcaggagtttgagancagcctgggcaacanngnnagaccgtctctancaaaagaaaagaaaaagcctccct

SEQ ID NO: 81813 - DNA, 1681 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccaaggcgcttctccgatgatagagacaaaagacttctgcagggccagaatggccagttgagagaaaggagactacctaggagcatactggtagagaagcttgggcaccaacaagggcccaaggagcaacaacagagagaggcacaatgatatggtgacaacaatgtggaaaagggacaaaaattagagaagtcatccaaaacacaaatatacacacgatatccaaatggtcccaatcaggagataagagaccacacaaggacaaaagagaatgaagaggaaacgaaaccacattaaagagaggataagtagctaataagacccctggtagtcgtcccctcggtcgtcttgtcgacgattggaccagactcagaatacgaaagtaccactataactcagctaaacaccataacatgtact

SEQ ID NO: 81814 - DNA, 340 bp, Homo sapiens
gggcagctcttggcctcccactcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81815 - DNA, 2897 bp, Homo sapiens
gctgggctcagccggacggttcctgctgtggctgcccaccccctcattgcaccagcctatgctcagctgcagccacaccagctcctcccacagccatcctcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccagtgccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81816 - DNA, 2474 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81817 - DNA, 2955 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctgaaaaaaaaaaaaaaaaaaaaaaaaaaaaaaaaaaaaaaaaaaaaaaaaaaaaacaaaaaaaaaaaaaaaaaaaaaaaagagggggggggggccgaagaaagaccccccgcgaggagggggcgccaccaaaatagtagccgcgccacccgcacgcggtgttttgttgtagagaagcaggggcgcgcccccaatagaggggaggggcggctctaataataaacgacgacgcagccacgcggggcgcggtagtaataacaaccccgcgcgtgcgtcggggcccaatacgccgcgctcgccgcgcgacgagcaccctggagaggagagaggacccccacaaccgcggggggggggcgggacaccaattgtcgggcaccagccaccctccg

SEQ ID NO: 81818 - DNA, 3030 bp, Homo sapiens
  misc_feature (1052)..(1052): n is a, c, g, or t
gctgggctcagccggacggttcctgctgtggctgcccaccccctcattgcaccagcctatgctcagctgcagccacaccagctcctcccacagccatcctcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccagtgccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcatatcgaggcacttcagatggaactctgcgagatgtgcatgtgcccgtgatctgcaaggactgcagaccacgtggaaagagaaacaatctgtcattggatctaacaatggggtagtaccccaaagantcctggattgcagttccaggggtagattccaagatgaaggaaggtgtgtcgtccccctcaaatctcaaaggtgttgaagcgtcatggtgggccgcgagtggaacttgtgcctataaagttcagggcgttccaacgcgcttctgtatccatggcttgtgcaaatgaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81819 - DNA, 2337 bp, Homo sapiens
  misc_feature (313)..(313): n is a, c, g, or t
gggaacacagagcagggagatggacatcgctgtgctccagcgttcgccgtgctactgccaccccagatactggtggagaagtgaagtcgacctaccaggcacatgtgtgaggaggcgcacaatagtctcatgcacggccatgattccatcagcatactgggtattcggtgcatcgcgacggcaggctgggtcggcagaccgatatgtacccgagtgtgtgatcgctcagttgcgccatgcctgtgtggaggatgtctggaaggaaggaagatatgcgaggagggcgttccttgccgtgtagtagagacattcncagaagagatggtgcagtcagacgcaacgcgaggccacgtgagacgtcaggaaggcaatgggcagggaggccggtatcatgcgaaggaagtcgcaatagcaggatgggtgcatcgcgcgctgaagagtcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81820 - DNA, 2649 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccagaataccctcaccgccaccaaatccccgacagtttggtcccatgacagcatcagtttgaagtccaggctctcatcattgaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81821 - DNA, 1640 bp, Homo sapiens
tttacaaaatgttcttttatttcataacagagaccctgtttcttccaatctccactaagagtttcctcactttcctttaggcctccccagcagcttccctaaaggccatgagacttctatatacagtctctcaaagcaccttagacactcacgctttccacagagtccttctggctcctgcctgtggccagttctgaggccacgcccacatctatagagctgtttgatgtcagcactccttttccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81822 - DNA, 1146 bp, Homo sapiens
tctacaggatcccaacgctcgaaaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81823 - DNA, 2202 bp, Homo sapiens
  misc_feature (2202)..(2202): n is a, c, g, or t
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctccgtcactatatgagcagttagttagaggaggtgtctatagtctctggn

SEQ ID NO: 81824 - DNA, 2307 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81825 - DNA, 2206 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81826 - DNA, 970 bp, Homo sapiens
aaagagggtccgcgttagaggtaatatctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81827 - DNA, 1814 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81828 - DNA, 1710 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccactcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81829 - DNA, 1776 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccaaggcgcttctccgatgatagagacaaaagacttctgcagggccagaatggccagttgagagaaaggagactacctaggagcatactggtagagaagcttgggcaccaacaagggcccaaggagcaacaacagagagaggcacaatgatatggtgacaacaatgtggaaaagggacaaaaattagagaagtcatccaaaacacaaatatacacacgatatccaaatggtcccaatcaggagataagagaccacacaaggacaaaagagaatgaagaggaaacgaaaccacattaaagagaggataagtagctaataagacccctggtagtcgtcccctcggtcgtcttgtcgacgattggaccagactcagaatacgaaagtaccactataactcagctaaacaccataacatgtact

SEQ ID NO: 81830 - DNA, 1657 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggtaaggcccttggaaattccatgtctccccggaatagcaaggaaagagaaaatgagagaccctcccaccaccaggaggattaggtagtttagttaatgactcaggttcaggaactggggtgcagaaatgagtgagatgagctccctgcctataagagcttgcttatattcagcatagaatgcaaactataaatattccatagctgtaattctgtatattttctggcatgggaagtgatctgtgtgaaatacagagatgataatgtaattaactgtctctctctcctgggagagattaggaggggagtcaggtagagtgtaggatatgtgtcaggaacatcaaaattaagaaaatagccaggtgtggtggctcacacctatagtcccagcactttgggaggctgaggtggaaggattgcgtgaggtcaggagtttgagaacagcctgggcaacatggtgagacctgtctctaccaaaaaaaa

SEQ ID NO: 81831 - DNA, 1230 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccagcagtaagaagccaagcaacaccttccacattctgcctgaaaatctccttagcta

SEQ ID NO: 81832 - DNA, 1047 bp, Homo sapiens
tttacaaaatgttcttttatttcataacagagaccctgtttcttccaatctccactaagagtttcctcactttcctttaggcctccccagcagcttccctaaaggccatgagacttctatatacagtctctcaaagcaccttagacactcacgctttccacagagtccttctggctcctgcctgtggccagttctgaggccacgcccacatctatagagctgtttgatgtcagcactccttttccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81833 - DNA, 338 bp, Homo sapiens
caaagatagaattcccgtctgtttatccgggttaactgttcatagcacggttgggaaatgaagaaacactgctagctgattagctgcatgcgttgttgtggaactgactatactcatacttggtgatgtgtccattgaaactgtgccacttttaaatgggtcactgaggggaggggactgcttggtttgcattgtcgcttggccccacggtaaaagccgggcgcagtttgagtccttgctgtccctccctgggcgtggactctggttctgatctcccctgctttgttttcctactctctctcgtgcagagacagggcagggcattgttcatgcactga

SEQ ID NO: 81834 - DNA, 2569 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81835 - DNA, 2383 bp, Homo sapiens
gctgagaaacacggtctgtaccccacctcaagagctgaaggtctacttgaaacgatgaaaaatgcacaggaaaaaaattacaatagaaagtaaaatgcgataaatgccatagatggatttgagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81836 - DNA, 2422 bp, Homo sapiens
ggggcagttgatggtggtagagaacagccctgggaagggggcgggagagagttacagaagtgaggagatgaagtcttgcacgtctaagacaatgagacagctcatgagagatgctgtttgaagtggaagagaggaagttcactgtcgtgtggttgtgtatagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81837 - DNA, 2563 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggattatctttccaaggtccagaagaggggggtcagtgatcaggaataattgacaagacccttggttagaagtttcccacacaaactcaggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81838 - DNA, 2266 bp, Homo sapiens
tcccagacagaggtgttctgcatgccaagctagagttcagctatcttcagccctcattcccctcaggctgttggagcagccaggccactccccagcaggacagtggacagtagtttcccgtcacagggtaacatttatagtggaataagtcaggtgtgagctttcgccctggtccaagtccaggtgtctcaaacattttacagacattatctcatgttgtaagaccagacctagaaagtgagtggtattacccccaactccagataaggaaacggaggatcagggcttaagtgacttaaacccaaagtcacacagctagtagttagtgatggagttaggatctgaaccaatagatggactcaaaatttgtcagacagcttggctgtgctcattctgcctacggcccataagcacaatgactactgtgacatcccctgttcccctgtccctgaaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81839 - DNA, 1716 bp, Homo sapiens
agagatggtttgttcccccatcctgaagaaaactctctgctcccagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81840 - DNA, 1396 bp, Homo sapiens
ctccactcagcctcaggatggggaatagccaagaatggcagcctcagcgcagaggcaaggtcagaaagagacggcgcttcagagtttcctttccagacacccctccctgcactgtgaagttcccctgaccgccctcctggttcacaaagagcattaagaaagctgcggtggtctgagcaacatagcgggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81841 - DNA, 1080 bp, Homo sapiens
aacaaacttacggctaggtacgaggccgcgtgttaagggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81842 - DNA, 2367 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81843 - DNA, 1976 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccaggggtatatggtcagggctccccaacctgagttgggttacttcaagggcagccagcaggcctggatggaggcctagaaagcccttgccttccttcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 81844 - DNA, 1736 bp, Homo sapiens
  misc_feature (1648)..(1649): n is a, c, g, or t
  misc_feature (1652)..(1652): n is a, c, g, or t
  misc_feature (1657)..(1658): n is a, c, g, or t
  misc_feature (1660)..(1660): n is a, c, g, or t
  misc_feature (1680)..(1680): n is a, c, g, or t
  misc_feature (1695)..(1696): n is a, c, g, or t
  misc_feature (1698)..(1699): n is a, c, g, or t
  misc_feature (1712)..(1712): n is a, c, g, or t
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagatcatgaagaagatgtcacgacaccactaacgcatacctgaaaactcgcgtgaactaaacaatgaatgctgaccgacagcgggggctcatgcctgtaatcccagcactttgggaggccaaggnnganggatnncntgaggtcaggagtttgagancagcctgggcaacanngnnagaccgtctctancaaaagaaaagaaaaagcctccct

SEQ ID NO: 81845 - DNA, 1980 bp, Homo sapiens
ggcgccgcatgtgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccagaataccctcaccgccaccaaatccccgacagtttggtcccatgacagcatcagtttgaagtccaggctctcatcattgaggtgagatgaggctcctggggtccagttcttcaagtataggtcctctcagtctgaagatctgagaactagagagagaggctatctgctcccttccacaaacccaatgcacagtgggacagccataggataaccattacagacatgcccatccaaaaagggagaaacagggagcgtacaagagtcgctgatccattccagttccgaaatccgctagggtttatggtggcatttcctcaattgggactcaaagcctgggagtgatttctgtcttggttctgccctctgagttctccttccttttctgtgaaaagtagcctgtattttcagtgtagtcgttttctcagcctgcttcctcctttttattttatattacctttgacttttttgttttttgtttttgagatagaggcttgctccatcacccaggctattgtgcaatggcgtgatctcggctcactgcaacctccgcctcctgggttcaagcaattctgcctcagcctcttgagtagctgggattacagacattcgccaccacacacagctaatttttgtattttagtagagatggggttcaccatgttggcaggctggtctcaaactccttacctcaggcgatccacccacctcagcctcctaaagtgctgggattataggcgtgagccactgcgcccggcctacctttgactcttaaaatcagtaattcagtatttcttaaaataattgt

SEQ ID NO: 81846 - DNA, 874 bp, Homo sapiens
gctgggctcagccggacggttcctgctgtggctgcccaccccctcattgcaccagcctatgctcagctgcagccacaccagctcctcccacagccatcctcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccagtgccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgatgagaaggggttttgaacagcagtccattccactgtagatttgctctaattatcagaaagttgcttttcaaatgaagtcaaaacctgctctcttggaatttgccagcattggtcatgattctgtcttgtgaattataagagtccatcttatacagtgtttgtagacagttgtcggactgtctcttgcctctccccccattaaaaaagagaaaatctccaggctaaacatctgagac

SEQ ID NO: 81847 - DNA, 1041 bp, Homo sapiens
gtctcttctgccagctctggtgcagtggtgtaaaggtactactcataggagaggcaggccataagaatagagggctatgtatctttcccttagaagactgatgatacataagctggaattttatttgtaagacagcatagggtatttcaagcatagggacactgttgaaaacaatgaagattcttctggtggacaattaagagtaggcttgttgcttcatgatagcaacaagatagtggcagaccagctagaagttaagcaaagacaggcagaaaaagaggtaaaaaatgccctcttggatttggcactagccacaaaatttggcctcaaatattacccctataaagaagcctgttatagattgaatgtttatgtcccccacaattatatgttgaagcacaaatgccagtgtggctgtatttggagatagggcctctaaggaagtaattaaggttaattggggttataagagtggggtcctgatctgacagaattaatgttcttataagaagagactccagatagctcactctctctctctttttgggtgcacacactaaggaaagaccacgcgaggaagtaacgaaaaggcaagcatctattagccagaaagagaaccctcaccagtgaatttgctagcagcttgattatggacttccatcctctggagctgtgagaaaatacatttttgttgtttaagccacacagtctgtggtatgttgttatagtagctgaagcagacaaatttaattggatcagattgttggtcaattcatacctcagggtattattgaaaaccatagagcaacaattcagcaaacaattaagaaggccaaaatctgggtgtgataccaacacaggcagaacaatcacttaacagtgagatagtggaaagaaacagtcaaagtgaacactactaaaatgattattatcccttggaaatgggagaggataagaaagactgcatctacccaatgatgcaccttctgaggaatggcaacagaggctgcgcatgcagggaaagtcagacaacatctggta

SEQ ID NO: 81848 - DNA, 593 bp, Homo sapiens
aggagtgaggagcctttttttaagggtaagcagtctcaggactgctaatataaactcttttgcatagtaggtggtaggacttcgttatgacaggttctacaggtccactgtatgagcagacattagctgggactcaggcagcacgtattactccttgcaaccaccaccaagaaagatgatcagacactgctattgttctacccgatagttccattctagtatgagagttgctgtgtggaaggaagtgagtatgatgaccaaacagtggagtaaatgtttgcagacccctgaaacatgtgaacttcttatgaattgagtacagctccccagccctgtctgtctcacccattctcctctccacatatgtgggatgtttcaggactcggtggcttttgaggatgtagatgtgaacttcacccaggaggagtgggctttgctagatccttcccagaagaatctctacagagatgtgatgtgggaaaccatgaggaatctggcctctataggatttttctgggtctctgttttagggatctccctcggaaggaccacgacattcgagatcactacttaccgcggtgagcatctccccg

SEQ ID NO: 81849 - DNA, 3196 bp, Homo sapiens
acttggtttcgcttcgctagtcccagaggcccagagtggctcgcctggagtctctgtggcgcggtttcctgtacctgccttgggatccggagggaggaagctgggacacccgggagtcaggaaatggactcggtggcttttgaggatgtagatgtgaacttcacccaggaggagtgggctttgctagatccttcccagaagaatctctacagagatgtgatgtgggaaaccatgaggaatctggcctctataggtaaggattgtatacttccatcacttagcaattaaagaagaagtgcttcttgtgcagtgatgctgttccatggtttgcatcatggagggagagtacttggggggctaaaacaggcatagtcacagggtatcatgaacctagaatctaataatttttctataattttgcactaattcagaatttttctgggtctctgttttagggaaaaaatggaaggaccagaacattaaagatcactacaaacaccgagggagaaatctaagaagtcatatgttagaaagactctatcaaactaaggatggtagtcagcgtggaggaatttttagccagtttgcaaatcagaatctgagcaagaaaatccctggagtgaaactctgtgaaagcattgtatatggagaagtcagcatgggtcagtcatcccttaatagacacatcaaagatcacagtggacatgaaccaaaggaatatcaggaatatggagagaagccagatacacgtaaccagtgttggaaacccttcagttctcaccactcctttcgaacacatgagataattcacactggagagaaactctatgattgtaaggaatgtggaaaaaccttcttttctctcaaaagaattagaagacacatcatcacacacagtggatatacaccatataaatgtaaggtgtgtgggaaagcttttgattatcccagtagatttcgaacacatgaaagaagtcacactggagagaaaccctatgaatgtcaggaatgtggaaaagccttcacttgtatcacaagtgttcgaagacacatgataaagcacactggagatggaccttataaatgtaaggtatgtgggaaaccctttcattctctgagttcatttcaagtgcatgaaagaattcacactggagaaaaaccctttaaatgtaagcaatgtggtaaagccttcagttgttccccaaccttacgaatacatgaaagaacccatactggagagaaaccttatgaatgcaagcagtgtgggaaggccttcagttatctcccctcccttcgactacatgaaagaattcacactggtgagaaacccttcgtatgtaaacaatgtggtaaagcctttagatctgccagtacctttcaaatacatgaaaggactcacactggagaaaaaccttatgaatgtaaggaatgtggggaagcattcagttgtatcccaagtatgcgaagacacatgataaaacatactggagaaggaccttataaatgtaaggtatgtgggaaaccctttcattctctgagtccatttcgaatacatgaaagaactcacactggagagaaaccttatgtatgtaaacattgtggtaaagctttcgtttcttcaacatcaattcgaatacatgaaagaactcatactggagagaaaccctatgagtgtaagcaatgtgggaaagccttcagttatctcaactcctttcgaacacatgaaatgattcacactggtgagaaaccctttgaatgtaagcgatgtggtaaagcctttagatcttctagttcctttcgactacatgaaaggactcacactggacagaaaccctatcattgcaaggaatgtgggaaagcctattcttgccgtgccagctttcagagacacatgttaacacatgctgaagatggaccaccttataaatgcatgtgggaaagcctttaatgctctgggttcatgtcagatacattaaaatactcactgaagagaagccctatgaatgtaagtaacgtgggaaagcatgaaattctgtcagtgccttttttaatacatgaaagaattctagagagaagccatatacatgtaagtaacatgggaaagctttcaatcattttagttcctttcaaatacatgaaagaactcatcatggagaaaaccaaacaaatgctttttggaaaggaacccatatttgagagaaaccctgggtaaagggtgtaggaaaggttttgtcatcacacaaccctgtcacacatgaatgtgtagtggagagaaccttggtaaatgtaaagagtgtgggagagcctttagtcattttagttccacttgaagccatgaaagaacacacaaaagagaaagctcttgaatataagcaatgtccacacgtttttagccagcccacatgctttcaacaacatgtaagaatgtaccctggatcaaaacactataaatgtgaaaactacaaggaaggttttccattatacttttaaagtcatttgagggctctggctctgtggctttgtgggttaaagtacttgtctggcaaacaggagatgctggatttcaatcccagcagggcctcactagttgaggtattgaatttgaacagatgttttggctctggctgggtgtggtggctcacacctgtaatcccagcactttgggaggctgaggcaggaggatcacttgaggtcaggagtttgagaccagtgtgcaaaacatagcaagacctcatctcagaaaaaaaaaaaaagtcatttgaaaacttctaatacagcaaaatcctataaatgtaagtacttcaaaaagcctcatgcatagcgggtcatgtagtctctagaaaatacataacctgatggaaatgtagaagctatatgtatattttgttaattagtggctcatatttaaaatagttctctgactatggatttcaaatgcttaatctcacaaagaaatgttaaattgatataatcctgtaagtaatctgaaagcaatagtgcatgaatttcataggtagtgttgttttaggtcagtaaataaaatatttgtctttccattttgaaatgtgtttaatccaacaatgaatttaaatgtgtttctcatattcaggtatgttaaattgtatatggttgcttaattgttctgtgattgaggaccactgaaaaataagtcttaataaatgttggtatgaaccta

SEQ ID NO: 81850 - DNA, 2994 bp, Homo sapiens
acttggtttcgcttcgctagtcccagaggcccagagtggctcgcctggagtctctgtggcgcggtttcctgtacctgccttgggatccggagggaggaagctgggacacccgggagtcaggaaatggactcggtggcttttgaggatgtagatgtgaacttcacccaggaggagtgggctttgctagatccttcccagaagaatctctacagagatgtgatgtgggaaaccatgaggaatctggcctctatagggaaaaaatggaaggaccagaacattaaagatcactacaaacaccgagggagaaatctaagaagtcatatgttagaaagactctatcaaactaaggatggtagtcagcgtggaggaatttttagccagtttgcaaatcagaatctgagcaagaaaatccctggagtgaaactctgtgaaagcattgtatatggagaagtcagcatgggtcagtcatcccttaatagacacatcaaagatcacagtggacatgaaccaaaggaatatcaggaatatggagagaagccagatacacgtaaccagtgttggaaacccttcagttctcaccactcctttcgaacacatgagataattcacactggagagaaactctatgattgtaaggaatgtggaaaaaccttcttttctctcaaaagaattagaagacacatcatcacacacagtggatatacaccatataaatgtaaggtgtgtgggaaagcttttgattatcccagtagatttcgaacacatgaaagaagtcacactggagagaaaccctatgaatgtcaggaatgtggaaaagccttcacttgtatcacaagtgttcgaagacacatgataaagcacactggagatggaccttataaatgtaaggtatgtgggaaaccctttcattctctgagttcatttcaagtgcatgaaagaattcacactggagaaaaaccctttaaatgtaagcaatgtggtaaagccttcagttgttccccaaccttacgaatacatgaaagaacccatactggagagaaaccttatgaatgcaagcagtgtgggaaggccttcagttatctcccctcccttcgactacatgaaagaattcacactggtgagaaacccttcgtatgtaaacaatgtggtaaagcctttagatctgccagtacctttcaaatacatgaaaggactcacactggagaaaaaccttatgaatgtaaggaatgtggggaagcattcagttgtatcccaagtatgcgaagacacatgataaaacatactggagaaggaccttataaatgtaaggtatgtgggaaaccctttcattctctgagtccatttcgaatacatgaaagaactcacactggagagaaaccttatgtatgtaaacattgtggtaaagctttcgtttcttcaacatcaattcgaatacatgaaagaactcatactggagagaaaccctatgagtgtaagcaatgtgggaaagccttcagttatctcaactcctttcgaacacatgaaatgattcacactggtgagaaaccctttgaatgtaagcgatgtggtaaagcctttagatcttctagttcctttcgactacatgaaaggactcacactggacagaaaccctatcattgcaaggaatgtgggaaagcctattcttgccgtgccagctttcagagacacatgttaacacatgctgaagatggaccaccttataaatgcatgtgggaaagcctttaatgctctgggttcatgtcagatacattaaaatactcactgaagagaagccctatgaatgtaagtaacgtgggaaagcatgaaattctgtcagtgccttttttaatacatgaaagaattctagagagaagccatatacatgtaagtaacatgggaaagctttcaatcattttagttcctttcaaatacatgaaagaactcatcatggagaaaaccaaacaaatgctttttggaaaggaacccatatttgagagaaaccctgggtaaagggtgtaggaaaggttttgtcatcacacaaccctgtcacacatgaatgtgtagtggagagaaccttggtaaatgtaaagagtgtgggagagcctttagtcattttagttccacttgaagccatgaaagaacacacaaaagagaaagctcttgaatataagcaatgtccacacgtttttagccagcccacatgctttcaacaacatgtaagaatgtaccctggatcaaaacactataaatgtgaaaactacaaggaaggttttccattatacttttaaagtcatttgagggctctggctctgtggctttgtgggttaaagtacttgtctggcaaacaggagatgctggatttcaatcccagcagggcctcactagttgaggtattgaatttgaacagatgttttggctctggctgggtgtggtggctcacacctgtaatcccagcactttgggaggctgaggcaggaggatcacttgaggtcaggagtttgagaccagtgtgcaaaacatagcaagacctcatctcagaaaaaaaaaaaaagtcatttgaaaacttctaatacagcaaaatcctataaatgtaagtacttcaaaaagcctcatgcatagcgggtcatgtagtctctagaaaatacataacctgatggaaatgtagaagctatatgtatattttgttaattagtggctcatatttaaaatagttctctgactatggatttcaaatgcttaatctcacaaagaaatgttaaattgatataatcctgtaagtaatctgaaagcaatagtgcatgaatttcataggtagtgttgttttaggtcagtaaataaaatatttgtctttccattttgaaatgtgtttaatccaacaatgaatttaaatgtgtttctcatattcaggtatgttaaattgtatatggttgcttaattgttctgtgattgaggaccactgaaaaataagtcttaataaatgttggtatgaaccta

SEQ ID NO: 81851 - DNA, 495 bp, Homo sapiens
gcacttgggagactcctgaacaccctcggagaagccagaaagccccgggagatggctccgtctgctgctgtaccagaccgggtcctgcaaaggatgcatcctccgagcctcctccctgcacgtccagtggggcctgccccgattctacctgagggacccactggaggagaggcacggggatgctgcctgagcagcggacccttctggcgcggagcaggctgtccccaggcagagtccgacgggtccttccttctgggtgcccccggcttcccggactccagcaggcctgggaaggccccgggcccccttagccgatgcccagagagtctccatttctcaagctttgccaccgaactcatcggtcggtgcgcctctgatcgcagggcaagggcctgcgcacccccaaagacaagcggggtccccggaaggcccccaggcagaaatgagcaccacggggaacggcccgcctccaagacaacctcggggacatggaca

SEQ ID NO: 81852 - DNA, 474 bp, Homo sapiens
aattggcagaggatgaggtctgacacggatggtcaaggaacacccaagtgaagaatcagaagcaaacaaggttgtcagtctgtagataggtgggggaagagggctcctggaagagggggtgcaaaggtcctcagaagagagcacttccagcctgttaggggaaggaccagcaatgggtgtggctggagccaggtgggtggggcagtcagagatgggggcaggagacacacagtgtcactctgggtcagatgcagagccactgcaggcagctgagcagaggagtggtgcccgatggatgtcttcaaatccgctcttggctgccgagttgagattaggcaaaggcagaagacagaagaccaagtagaagctattagcataatctaagtgacagatgatgaccagagtggtccccacaggtgtcatgagaagtggacagcttctgggtatagaacctatttatttttttaaaaagtg

SEQ ID NO: 81853 - DNA, 862 bp, Homo sapiens
ggaggaaactgtgagccctacagataaagtctgtgcttccagcgtcggtaaatcccagcaagcgccactacctggaggctgacactttcccatcttggcagtcagctccctacagaggtgcttctcccactgcccaagatccctgcctcctccttaaaccccaactgatagaacagaaaccaccacctaaggaacgtgaaggggaagcatctgaaacaccagaagatcttggattgttcctgaggacttcagaatctacagggacaaaaggcagaagcaggaagtccgaagtaaagatgactaagaaaaggcgggtggaaaagatttctgtgaaagtgtcagaggcaaagctctgaaagacctgaaactcatgccgaaagcaaagaacagcaaaaagacagtagggatgtgtctggagcaacaaggatcgggctgttcctggggcagccgaattcacagctctgttttactcctaatggaggatcttcctgctgcagcggcgagtagaccttactgtaaaggtgcaggcaaggggaggggaagggcaggcagctgcccattggagttcacatctccaagcctgagaaaatgtgttcctggatgccccaagccaatggaaaagcagaatcattgactatgtttgactccttctggtacctagcacagtatctgggacacagcaggtgctatgtaaatgtgttgagtgaatgaatgaatgaatgccattgaggagaatgaataaccccagaaaactagacatgggtagatgttgtcctaatttcaaaagaggggaaaatgagagtgagagtttcataaatgacaatctctaaacgatgttgctctctagcaaaattctagaatg

SEQ ID NO: 81854 - DNA, 808 bp, Homo sapiens
agttttatgtaattgaaagtgagaaaaatgggagaaaccacttaaaaaacaaacccgaaactctagaaagaacaagaaggtattagaataactattggaattaagttatagtaattgcttgtgaaataagtggaatattatgtcacatttatgcctaaatataagcagtgttagattcttaatatcctatacgtgagtatacttttatgaatatacttttattattgatgcaaagtgtactgaatgtgtaaaacttcaaaaaaaataacattttccagttccttatggactcattttaaggtactgtgttataaataagtaccctttcagcagagaaattggtagaaaattgtttgaaggaatggttttcttttgaaaataaagcgagtatttaatctgaaccttagttactgacataaaggagactaacgaagaactgaagtgcagacttgaattttaagcagtgtgacatggggctttgggcagacccgcttggatttgattattggctttgtcagtctgtaagctggacagtctgcaaaatggggacagtaatgccaatctcacatagtccttagtgaggactaaatgaaacaatatatgtaagtaccttgtaagtactgtagtgcttctggagagatgcaggtccaggctgagcatccctaaaaaatattagccaggcatggtggcgcacatctgtagttccaggctgaggtaggaggattgcttgagcccagggggctgaggctgctgtgagccatgatcacaccactgtactccagcctgggcaacagagcaagactgtctc

SEQ ID NO: 81855 - DNA, 636 bp, Homo sapiens
gctcggtacccttccgcacctttagtatacttttatgaatatacttttattattgatgcaaagtgtactgaatgtgtaaaacttcaaaaaaaataacattttccagttccttatggactcattttaaggtactgtgttataaataagtaccctttcagcagagaaattggtagaaaattgtttgaaggaatggttttcttttgaaaataaagcgagtatttaatctgaaccttagttactgacataaaggagactaacgaagaactgaagtgcagacttgaattttaagcagtgtgacatggggctttgggcagacccgcttggatttgattattggctttgtcagtctgtaagctggacagtctgcaaaatggggacagtaatgccaatctcacatagtccttagtgaggactaaatgaaacaatatatgtaagtaccttgtaagtactgtagtgcttctggagagatgcaggtccaggctgagcatccctaaaaaatattagccaggcatggtggcgcacatctgtagttccaggctgaggtaggaggattgcttgagcccagggggctgaggctgctgtgagccatgatcacaccactgtactccagcctgggcaacagagcaagactgtctc

SEQ ID NO: 81856 - DNA, 757 bp, Homo sapiens
cttcctcatcttggggctaggaccactgcaaatcctgcctgaagatcttactgcctaggaagcacattccagaaccctttctgagacgggccgtccagtgtccttgtggccttttccattgggaagtgcttcctggtgtctaaccatgatccctactgcttcatttccccctttgtttagcctttcacagaggaggaaagtggttggatatcaattgcctggtggttctcaaggcagcaccattaccttgctgcgtaccctcttcccacctacaatctcccttttctccacttcctgagagactgtgccttgactcagatacaagttgagacacaatcttcatgcagaaaagatctggctggtccctgtagtatcccacccttcccagcagctggaggtggggcttgctcactaggaggagcaaaataatgttaggcactggtgtttatgatcttatggggtcttcaccatccagggaggtgtaggtactattgttattcccattttacagatgaggaaactgaggctcagagaggtaaagtcgctttagcagatcaccagctgcggagcggctgagttggacgcccatcccagctctgcctgacgtcaaagtgttttgggataagggacagggggtggctgcaagtggcctcccactttgccccaagccggcttcttctcgccatgctggcctggaccatctcctttttggctttttgctgagtccgggctgggaatcctgtggctggaggcccaa

SEQ ID NO: 81857 - DNA, 504 bp, Homo sapiens
cagagatagtgaaatatgaataagaccaagagggacttgttctctgctcaatgattcagcagcttgggcacagaagcaccactgaagatgtaagccatgtctcagggcacttgtagatcatgcttgttttccacttgtggaatctagagggcaaaatactgcatcaggcaagtgacagctcagctctgtactcctttaagaggtcagataaaaatggcatatcccaaagaacagttcttatttcaactgaagggagaaccagcaataaccctgaaaaaaataacccataaccaaagatgatagccttttttcagtgcctactgcttctctggaatgagtttctgtgttctctgtgaagggacaggaggaacaggtcaccctttccccacccttcagtgacataggacatggctgtcactgacacagcacttgacatattctctggcattggcaggtggttgttacatgtttattaaataaacaaatcttaacagaaagaaaaaa

SEQ ID NO: 81858 - DNA, 542 bp, Homo sapiens
tgctatagtagagaccttaatctcatacaaaaagcacacaaagtaattattttccagtttccacattttccagttcacatttaaagactctgaagacttaaaatgttaaaacttcctttgaagagagttcgtagatcaagggcagtattttctatttttgaacacgtcttctacacttgatgtgttttttccagcaactcttctcttgaagcatctgcaacagatgaccattggcaaagtaagccagaactttatataccaggtataggtttacaagcctattggtttaaaaatactctgccctaattttcagtgtcttccttagaatagtgccagaatgctgacattttacacctgagtctttacactttttaaatgataagaccttagagtaatttttgtataaggactgcagtatcactttatgtgagattatctttgaacaaagataaattctggtcagattgctagtgaggactggcaagaatgaaagatctttagttgaaatttgcatagtattcatgaattgttggtatacttac

SEQ ID NO: 81859 - DNA, 102 bp, Homo sapiens
tttttgtttttaagcattctgttgagattgtttttatgtttagattgtttctatgacaacgtgtgtacactgtatgtgaattccttggatcctgatggttat

SEQ ID NO: 81860 - DNA, 391 bp, Homo sapiens
gtttaggatagtgatagaacaggtagtgactagcgggggaggactttttacacagaatgtgggactttccctctctggctgtctccaggattccactgcattttccagtggctgtggttgccatattgcatttatttgtcatgtcttcatagtcttctctggtatatgacagttcctcgttctttctttgtcttttatggacttgacacttttgatgagcctatattgcatgtcaactatttgtggaatattcctcaatttggatttgtttttttctcatgattggattgaatttgtgcagatttggtaataatgttgtaggaatgatattgcagttaacttgtatgaaatcaaggctgcatgatactgatgcaaactttgattggttagt

SEQ ID NO: 81861 - DNA, 806 bp, Homo sapiens
cagaatcttgctctgttacccaggctggagtgcaatggcatgatcttggctcacagcaacctctgcctcccgggttcaagcgattctcctgtctcagcctcccgagtagctgggattacaggcacctgccaccacgcccagctaatttttgtatttttagtagagacgaggtttcaccatgttggcgaggccggtctcgagctgacctcaaatgatccaccctcctcggcctcccaaagtgctgggattacaggcgtgagccaacgcacacggacgagatcgagattattaacctggacttatgaaccatcagagaatgaaagcacaattgccagaatgtgaattttccaggggaagggggtccccgaattcatcagcccttccaaagcactcttctcccaaatgaagttaagagctgtgatctagagagaggtgtctgtcaggaggtctagggcctacgccattgcccttgggcctctgagaaaagagatctgtggatgggcctggggggtggtaatttgggagccactgaaatgaacttgcaaaaggttttgggactattcatttatctgcagaaggctcagaaatttcattagattctcaaaggctcaaggactctaaaaaggttaaaaatcccttacctggagtttcaaggatcatcttttttgcctcacaatattgtattttctgatattagattttattttattttttgagatggagtctccccctgtcgccaggctggagtgcagtggcaccatctcagctcactgcaacctctgcctcctggcttcaagcgattctcc

SEQ ID NO: 81862 - DNA, 99 bp, Homo sapiens
aataaataaagtgtataaaggtgagccatattgggaagaaggggctgatagaggagttagaacaaccaggtaaccagatttttttttcctattcttttg

SEQ ID NO: 81863 - DNA, 377 bp, Homo sapiens
attgctactgagaaacaaggcattccacccactagaatgcaaagacaccagagagaattccagctctgtgcaggaacccctggggagagggtcagtatccaatcaccaaagaggaggatgtaagacttacatgcagcatggggtactagcctctcaggccacgaggtccactctgaccttctacccattttacagatgagggccacaagtcccagagggttaaagtgacttgcacaaggtcacccagcttcaatcagggcaaaatgactcaatttttcaaaactgctatcacaaagcatttttcagtgcatggcaagcattccacacaaaaagcatttgcacacacaaagaacttacaatgaaaattatgtcttaca

SEQ ID NO: 81864 - DNA, 513 bp, Homo sapiens
gttgaagaggttgggttaagttattgttaaaggtgacttccagttctgaatttctgcggttatacttcgtaaatgtcttacaaaagcagattgtcaagtacaacgtataatctttttagattgtgtaagaaatcaggaagtaggatgttctgtgttttgtaatttaaatatattctttctgtattttattgctatggttagtaagtttcttgataacttagataaaaataaaataagtattttaacaggctgaaagcggaggagagaaaagatgttttgtgagataggctaacacagattttgttgtttcctagagtgtgacaatttcctactttcacctttggacagctactgtattatgaacacactttttacctttttttttttttttttttgccataatctcatacataggacagtttccattgcatacctttgtctttctgcacataaaatttaaatttttgttattctaaaacacttctgtcttatgctgaagtatatagcgtaaga

SEQ ID NO: 81865 - DNA, 478 bp, Homo sapiens
  misc_feature (28)..(28): n is a, c, g, or t
gccactgtcacctccccctcctctgggnagccctgcctggactcccactggggtccagtgcctcttctgggacccaaggctgacgtctctttccctcctgccagaatgtgagaccctggggtcatctgtatctcctacaccccctccttaccgtgcatacggcccaccggattattcactccctcgaccattcatgtagtctattctctatggtgggctccctgctaggccctaaggaatttagtggtggaccagacccagaagtggaccctgccctactggagccccccatctgattgggaagaaagaaagttaaccataatggtgagtgctatcaggcccttttttttttttttttttgccataatctcatacataggacagtttccattgcatacctttgtctttctgcacataaaatttaaatttttgttattctaaaacacttctgtcttatgctgaagtatatagcgtaaga

SEQ ID NO: 81866 - DNA, 454 bp, Homo sapiens
atctgcatacgagctgatcttattgcttcctactagtccctctggagctcacaaagtaaaggtcccacaaaaaaccattcatgcttttattctagcagagaccaattctgttcaaaacccactgcatacggtgactagatttccaagagttaaggtagcttaaacaatgtgacctttattatcacaaaaccaaccagggtatgtgtgtgcattaggggtgagaaggagttcacagtgtgggtgactggcaggttggaaaattccatcccaagtgtcatgatgacacaagatactttcagtgccacttcaccaggcagaaacctccatggctgaagcacttctgcccagacatcacttggcctgctggactcactcaactaactcagtccgacaggctgtgcttggctcatgttaccagccggatcctgtgcccaccatggctctgtgcttggcc

SEQ ID NO: 81867 - DNA, 944 bp, Homo sapiens
agcggaaaagtttaggggcctatttttagccttctaaaaaggaagccagtaattttatataccatgaaatgatgtttcataaacaaaggagaaataaaatctttcccagacaagcaagcactaagggaattaccagaccagacctacaagaaatgctcaaaggagttctaaacatagaaatgaaagaatgatacttgccaccagctcacaggccctataaagcaattacacaattgaggctataaaacaactagctaacaacactatgagtgaaacaaaaccacacataacaatgttaaccttgaacataaatcacctaagtgctctacttcaaacacatagagtggcaaattgaataagaaaacaagacccaagctttttctgctttcaagagaaccatctcacatgtaatgacaccaataggcttaaagaaatggagtgcctctccatctcttcatcatggaaaacaaaaaaagcagcagttgctattcttgtatcagataaaacagactttaaatcagtaacagttttgaaaaaagataaagcatcatataatgatcagttatttgatacaataagaaaatttaactatcctaaatatgtacacacccaacatcagagcacccagatttataaaatgaatactactagacttaagagatatacagccataccataataagtggaggacttcaataccccactaatagcactataaagatcatcagggtagaaaactaacaaagagactctggacttaaatctgactctggaccaaatggaccaagtagacatttatagaatactccaccccaaacccacagaatatacattattcttatctgtgcatgaaccattctttaaaattgacccatgctcagtcataaagcaaatgtcaacaaatttttaaaaattgaaatcacatcaagcaccaacttggacca

SEQ ID NO: 81868 - DNA, 364 bp, Homo sapiens
cgtattcaatattgttcagtattgaacattccttttcataaatgtaaatgagcatacttttatggtaaagcattaagttgcctatatttgaatttaaaaagcaaattttacataactctgacctgtaatcctagctctttgggatgccatgtcaggaggatctcttaaggccacaagtttgagaccagcctgggcagatcccacctctacaaaaaaaatccaaaatgagcccagcatggtggcatgtgcctgtagtcctagctactcaggaggctgagacgggaggatccctcctggctgcagtgagctacgatcataccactgcactccagcctgggcaacacagcaagcccctgtctcaaaa

SEQ ID NO: 81869 - DNA, 407 bp, Homo sapiens
taggttttcaactcctgttatacacattgttagtcttatgtttagttaggcaccataattacaaagtaatacaagtcatttgtcttactgtagttaaataaacaaaaaatacctgctagaaactaagtgaatgagtttctcatgaagctaaatgaatgaatttgatatctggaaatgtttcagagtggaagaatattagaatcttctctgatctgctccatctgtctctagtacagtggcctctacatgtgtgcacagcagctctggtcttagtgtctagctattactatttggtagatccatagatgggggggaaataaggagtcaggccagcaggttcaacttcttatttctcagtagcttcctataatgattccacctctaatgaggtgaattactactgcatg

SEQ ID NO: 81870 - DNA, 567 bp, Homo sapiens
cgaagtagaatagaaatgagggcagggaacttggctgtctagttcaccattatatcccctgtacacaaaacaatggttgggctgggcacggtggctcacacctgtagtcccagcattttgggaggctgaggcaggtggatcacttgaggtcaggagttcaagaccagcctggttaatatggtaaaacccctctctactaaaagtacaaaaattagctgggcgttgtggtgtgcacctgtagtcccagctacgtggggggttgaggcaggagaatcgcttgaacccaggaagctgagttgcagtgagccgagacggcgccactgcactccagcctgggtggcagagcgggaccctgtctcaaaacaaaacaaaacaaaaaggatgggccgggcgctgtggctcacgcctgtaatcccagcactttgggaggctgatgcgggcggatcacgtggtcaggagatcgagaccatcctggctagcacggtgaaaccccgtctctactaaaaaatacaaaaaattagccgggcgtcgtggcgggcgcctgtagtcccagctactcgggaggct

SEQ ID NO: 81871 - DNA, 415 bp, Homo sapiens
gtgctgatatgtagttttaggactgctgcattattgttcctctatctttccgtttgtattagtaaagaactattagcaattttgcctcagtcttctaagcacgctttttgattggagaaaaccaaggtaccagaaaacttagataccatgtggaaagtcacagtttactgggtgtgtactatgtgttactagtgctttaataaatttcctcattaattttattctcccagcaagcctggcaggtagctgatagtatctttgctttacacatacagaaactagggcttagagatggtaagtaattgggtcaaggccacagaactggctggtagcagagccagaatttgaactcatgtctgcctgctccaaagcctgtgttctttatcccctcagtgcacccctactgttttgactg

SEQ ID NO: 81872 - DNA, 1549 bp, Homo sapiens
gacactctgaggagctctcagtagccccctcgcctcttactacagtgattgattaccctgcctgccagtagttaacacctctgccattgctgaggaggagaaagtgacagagctggccttgctcacagtgactatggactgcttgggggccacgaaggcactgtgtgtggggtgtgagttgtccctcgacactgggacttggcgctggatagtgaggtgctttcaaggttcacagaggacacagtcctagcccgtgagttggtagttaggcttttctgtctcagctcagcctcagatttgctactgtcctccctccccaggagtccctgtagggcccactgtttgtacagcattgcacaacatgcaggcgcaccacaaaagatcaaagggggtgacttccgacctgaacttgctacttatccattgacttgggaagaccacgcacttgtctataaatgccacagagatgtcactgcaaagcagtaggtaagcagattcgtaatcaccaccaccacactaatggcagcagctgaatttcctgtgtacagcaaaatgcccttgcagcctgtgaggtgggtatcttcacacctagtgctcactagccacagtggcagagccaggctgtgaacgtggctgctgcccccaaagccaggctggtgcactcacgtccagtttgtgccagggatggagaaagaacgttgatgctgggccccctcgcctggcctggggaagactgctgctctgtggggcagcatcatgtgagcattcattgacacaggagtgaaaggctcctgtgaaaaagctgctgtttcaccaaactgttgatacccctgctctaggactacagtcatgtttgccatttgctggttcccagtcccagggagtttctttttttcaaatttttaaatagctttattgagatgtaattcacaaaccataaaatttactttttatgattttaatatgtaaacttaaaaattttttttttatttttttagagatggggtctcactgtgttgcctaggctgatctcaaactcctggcctcaagtaatcttcccaccttggcctcccaaaatgtagggattacaggtgtgagccaccacgcccagcccaatatgtaaactttaacatgatttttatgagagtcacagatttgtgcaaccatcaccactgtctagttccaggacatatcatcaccccaaagagaaacccggtacccattcgcagccacccctcattccctcattcctcccactccttggcaaccactcaactgtttttcatctccatggatttacctattccggacatctcatattaatagaatcatacagtatgtggtcttttgtaactgactcttttcactagcatagtgttttcaaggttcatccatgctgtagctggtaccagtacttcatccctttttagtgccaaataatagtacatgctgaggaccgttttatttacccattcactagttgatggatatttggattgttttccactttcaggctattaaataatgctaaacattcaaatacaaattt

SEQ ID NO: 81873 - DNA, 477 bp, Homo sapiens
gacccgttttagtcggaatgaattcctgaccttcttgtcaggaggagacagaaacctgatcatctgtagtgtacggtggtatcgtgattacttaaatcatcaaatgtggttattgggaatgatgtgttttttcaagtggtatatgagaggtaaaattgctattgtagttgactgttgcagttataattttgtcaacatggtctgtaagagtgcaatggagtcggcccggcgtggtggctcacgcctgtaatcccagtactttgggaggccaaggcgggccgatcatgaggtcaggagatcgagaccatcctggctaacacagtgagaccccgtctctactaaaaatacaaaaaattagccgcgcgtggcggcacacgcctgtaatcccagctacttgggaggctgaggcaggagaatggcgtgaacctaggaggcagagcttgcagtgagccgagactgcaccactgcactccagcc

SEQ ID NO: 81874 - DNA, 121 bp, Homo sapiens
acggactagaggagtgcaaatagctggtaaaatctccttgaagagcaactgacaacatttaacctacaggacccaaaagtttcaaatgataaaaggatgttgtaaaacacaagctctcttt

SEQ ID NO: 81875 - DNA, 376 bp, Homo sapiens
gtaattttatatatattggtaacctaagattataaggctattaaaaaaggaaagcccaaacacattgagcattaaaaaatattattaataacaaaatggggaaaatttccttggcttgtgttactttacatacttttacttgttcctttatctgcttgagtgtctactatgtgccagactttgtttttggtgctggggatgtaatggaaagcaagacacacttccttttctcaagaagcttgagagggctgggtgtgatggctcaagcctgtaatcccagcactttgagaggccgaggcgggaggatcatttgaggctaggagttcgagatcagcctggtcaatatattaataaaaagaccatgtctccaccaaaa

SEQ ID NO: 81876 - DNA, 1039 bp, Homo sapiens
  misc_feature (40)..(40): n is a, c, g, or t
  misc_feature (986)..(987): n is a, c, g, or t
caggatccggagacggaaatgtccgaaggccgcagtactngaccctgtatttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaagcagtgctcaaagaaaaggaaaaaacgggacagagttgaagcatctagccttacctgaagtcagaacagggaagaggaagagaagcagctctgaagatgcagaatccctnnctccccgatcaaaagtaaagaaatggagatctaaaagatagctctctcttcc

SEQ ID NO: 81877 - DNA, 1052 bp, Homo sapiens
  misc_feature (999)..(1000): n is a, c, g, or t
ggagagaagcagtagtcaataaagagagtgccgtatttcgcagatggagctgagctgtggctgccagaagatagcgaacgaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaagcagtgctcaaagaaaaggaaaaaacgggacagagttgaagcatctagccttacctgaagtcagaacagggaagaggaagagaagcagctctgaagatgcagaatccctnnctccccgatcaaaagtaaagaaatggagatctaaaagatagctctctcttcc

SEQ ID NO: 81878 - DNA, 1045 bp, Homo sapiens
  misc_feature (60)..(60): n is a, c, g, or t
atggtttttaagcacttaacggggtcccttatttacagtcaagccccacataccgacagnccggcatgtatgacagtggtccccataagattataggaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagaggtaagaatcaagaataactactgtttatattaatagtttataatataaaagaatgttagcgtaatgattattatatgattatagcttacaattataaataatattagttttattaatgtaatatactattttaaagcttgatttggaaggcaccagaatccggaggaaaaaacctctgggggaaagaccaaaggatgaggatgaacgcacagtgtatgtggtaagcttaagaacccgggtccccagtcagaaactggcacagaaacaatataattaagttaaaaatttattgacattctgattgtgaaaaactctaatattgcttttaatttataataggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtcacagaaagcacttccatgttaaagttgaagggagcccacccaacatacaacttctttggacttcagagtatttagagctgttaatttcattctgtagtatgcaccacaagcagaaacaagttaaagcgtaattcctag

SEQ ID NO: 81879 - DNA, 552 bp, Homo sapiens
  misc_feature (499)..(500): n is a, c, g, or t
cggcacgagggatgttggagcggccgcaaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaagcagtgctcaaagaaaaggaaaaaacgggacagagttgaagcatctagccttacctgaagtcagaacagggaagaggaagagaagcagctctgaagatgcagaatccctnnctccccgatcaaaagtaaagaaatggagatctaaaagatagctctctcttcc

SEQ ID NO: 81880 - DNA, 1069 bp, Homo sapiens
  misc_feature (60)..(60): n is a, c, g, or t
  misc_feature (1016)..(1017): n is a, c, g, or t
atggtttttaagcacttaacggggtcccttatttacagtcaagccccacataccgacagnccggcatgtatgacagtggtccccataagattataggaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaagcagtgctcaaagaaaaggaaaaaacgggacagagttgaagcatctagccttacctgaagtcagaacagggaagaggaagagaagcagctctgaagatgcagaatccctnnctccccgatcaaaagtaaagaaatggagatctaaaagatagctctctcttcc

SEQ ID NO: 81881 - DNA, 1147 bp, Homo sapiens
  misc_feature (60)..(60): n is a, c, g, or t
atggtttttaagcacttaacggggtcccttatttacagtcaagccccacataccgacagnccggcatgtatgacagtggtccccataagattataggaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagaggtaagaatcaagaataactactgtttatattaatagtttataatataaaagaatgttagcgtaatgattattatatgattatagcttacaattataaataatattagttttattaatgtaatatactattttaaagcttgatttggaaggcaccagaatccggaggaaaaaacctctgggggaaagaccaaaggatgaggatgaacgcacagtgtatgtggtaagcttaagaacccgggtccccagtcagaaactggcacagaaacaatataattaagttaaaaatttattgacattctgattgtgaaaaactctaatattgcttttaatttataataggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagaaaaaaaaaaaagaaagaaaagaaaacaagtattaaaatagtaacttttgcaatcatttcagtttcttaacaacccaccagaagaagcaccaagaaaacctggcatatttcctaaaacagtgaaaaataagcccattccagccttaagagttgtgggtgagtatttttcaatatttaaataggtgtagttgaagtaagatgaactaataatgatggcacttttacagaagagaagagaaaga

SEQ ID NO: 81882 - DNA, 1012 bp, Homo sapiens
  misc_feature (60)..(60): n is a, c, g, or t
  misc_feature (959)..(960): n is a, c, g, or t
atggtttttaagcacttaacggggtcccttatttacagtcaagccccacataccgacagnccggcatgtatgacagtggtccccataagattataggaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagaggtaagaatcaagaataactactgtttatattaatagtttataatataaaagaatgttagcgtaatgattattatatgattatagcttacaattataaataatattagttttattaatgtaatatactattttaaagcttgatttggaaggcaccagaatccggaggaaaaaacctctgggggaaagaccaaaggatgaggatgaacgcacagtgtatgtggtaagcttaagaacccgggtccccagtcagaaactggcacagaaacaatataattaagttaaaaatttattgacattctgattgtgaaaaactctaatattgcttttaatttataataggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgaggaagtcagaacagggaagaggaagagaagcagctctgaagatgcagaatccctnnctccccgatcaaaagtaaagaaatggagatctaaaagatagctctctcttcc

SEQ ID NO: 81883 - DNA, 1029 bp, Homo sapiens
gaaaaatgtgatctaagttatgtgatcaaagattttttaacagtgaacaaatcaggcccactagatgatggcctttctttgaacaacatgcctagggttgctctatcatgtctacagttggtctgacttcctgacgggcatcacagacttgtgattaaacacagaggttatgggggaagttccaaaagcttaggactttccagatggttggaataagatcacacactctggctgcccttatggagatcaccgaacttttcaactcaaagtaaaatctgtggagtaaatggtcgatcaaaaggaaccaactatattgagcaccatgcgtgatcatctgatcgttactgctaccttgtgagttaaaggctactcttctcattttagaaatgagaaaagagatgcccagagaggacgagtaacttgccttaggtcacacagcttatattaatcacaataacatttgccgcaccttctgtattttttttaagttgctaagcttttggtgcatgtctggcaccgttttagttgtatattatttcatttaattgttaaaatgaccttctgatgcaggtatttgtagctttgccattccacagatgaagaaacagatgaaaggactgaattgttcaataggaaggagcagaatcaggatatgaacttgggttggcctgattcttggggctgcattctttccataacataattgcttgctgtgatgtcctgggctactctgccaggggtggttagtggagtgaatggagaataatttagacaaggtcagtaactcccatgccatctagaaattaaaagtttaaaaggcagagtctgcaactctccttgatttctacagaaataaagatgatccctcctgtgacagtgctaagtgacaattctgagtgtaaatgcgctttttggcacaaattgtcctgtcctaatagtcttgattataattataaaataatgggtttctgaaaggctgcaagcagttctgggaatggcaataaaggtttagaaatgaaaaaaaaatta

SEQ ID NO: 81884 - DNA, 3296 bp, Homo sapiens
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatga

SEQ ID NO: 81885 - DNA, 3358 bp, Homo sapiens
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgacattatgtgatacagtttaaacgataacacgtaacccagtgcaggaaataatacacttcctt

SEQ ID NO: 81886 - DNA, 3100 bp, Homo sapiens
gacttgaaagtgctgtgggctccgcatagagagttttacttcattaacagtcgcttatccgtcaggtccaaaagacgcagcggtggtactggtaaccagtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatga

SEQ ID NO: 81887 - DNA, 2996 bp, Homo sapiens
tgccaagtgaatcagagagacttgcagttctcggagagcacggaacttattcctgcccagagttcagacacagccagaaattaccatttcatacttcacagaatggaggtttcagcagccaaagccccaagtgccgcagacttgtctgagattgaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatga

SEQ ID NO: 81888 - DNA, 2914 bp, Homo sapiens
  misc_feature (6)..(7): n is a, c, g, or t
  misc_feature (17)..(17): n is a, c, g, or t
  misc_feature (19)..(19): n is a, c, g, or t
  misc_feature (54)..(54): n is a, c, g, or t
gctttnnatttcccttngntttgacctccccttcttcatctatttctttatttncctgcaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatga

SEQ ID NO: 81889 - DNA, 2506 bp, Homo sapiens
ggggccacagacgctattacagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatga

SEQ ID NO: 81890 - DNA, 3447 bp, Homo sapiens
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatcctcacccacagacaccgccagagaacttagtgggatgtgtggaggaggtctcccaaagtccagaattgctgaaaatcaagctgagacttacttccagaacctcaccatattcctctaacgaagccctttaaaggttacccagccatcaggagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatga

SEQ ID NO: 81891 - DNA, 3167 bp, Homo sapiens
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatctgtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatga

SEQ ID NO: 81892 - DNA, 3406 bp, Homo sapiens
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccattctgatgttggagcctgcgccagcaccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgact

SEQ ID NO: 81893 - DNA, 2153 bp, Homo sapiens
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatga

SEQ ID NO: 81894 - DNA, 457 bp, Homo sapiens
gaaagggacaggttgaacctacaattgcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatga

SEQ ID NO: 81895 - DNA, 4069 bp, Homo sapiens
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttg

SEQ ID NO: 81896 - DNA, 3208 bp, Homo sapiens
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctggccaaaaaccttgaaacaaaaatctggtaataaaatgtctataaggagcttttaaaagctacaagatattcctggggatctagaaggctacacacataggcagggccgggcacattcccaggaaatacctgagaagaccctaaccttccacctttggctgagtgggaggctctgagcaagccagcagtgaa

SEQ ID NO: 81897 - DNA, 2554 bp, Homo sapiens
gggccccaggagggagcccagattgcagcagcaatcataggcgagggaggaggacttctctcgaagccacccaagccatgaattgggcctggcttcctgaaccataaacaaatgcgagcttgttctccccgattcctcatttggtcccaagtatgactcagggttaggctgggtcctcaggctccgtgctgttggaaggaagtgggaggattccagggagttctgggaccttttcaaactgaagagaggaggctggctgcatcatgggagaagagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatga

SEQ ID NO: 81898 - DNA, 2543 bp, Homo sapiens
atctcctcacgccacacatctcctcactccacgcatctcctcactccacgcatctccccacagagagagcgtcgacgctctctctgtggggggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatga

SEQ ID NO: 81899 - DNA, 2306 bp, Homo sapiens
ctgtcacaatatcaacatgcagtagagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatga

SEQ ID NO: 81900 - DNA, 3014 bp, Homo sapiens
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatga

SEQ ID NO: 81901 - DNA, 1120 bp, Homo sapiens
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaaactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccagaagcaacgcttcatcggtctgt

SEQ ID NO: 81902 - DNA, 583 bp, Homo sapiens
tctgttgcccaggctggagtacagtggcacaatcatagttcactgcagccttgagctcttgggcacaagcgaacctcccacctcagcctctcaagtagctgggactacaggtacacactgccatgcccaactaattttgatttttcattttttgtaaagatggggtctcgctttgttgctgttataactccgtgttcacactgctatgaaggaataccccagactgggtaatttataaagaaaagaggtttaattgactcacagttccacatggctggggaaacttacaatcatggtggaaggcacctcttcacagggtggcaggagagacagtgagtgctgagcaatgggggaaaagccccttgtaaaaccatcagaactagtgagaactcactcactatcacaagaagagcatgggggttactgcccccatgattcaattactcccaccaggtccctcacacaacacctggggattatgggaactacaattcaagatgagatttgggtggggacgcagtcaaaccatctcagttgcccaggctggtctcaagttcctggcctcaaacgatcctctcgcctc

SEQ ID NO: 81903 - DNA, 441 bp, Homo sapiens
tcttactatattgtccaggcttgtgttaaaactgttactgaaacaccagaggtttggtccaggtcctgctgttttccactcagaaaaccaatcactgaggtgacacgtattgccagggaagaaggctttaatcaggtgctgcagccaaggaggtgggagctcagtctcaaatccaatctccctgactgactaaaattaggggttcatataacaggaaagaaacgtagcaatgtgtgggaaaacagacctctggaggtgaaaggaagcagtcatgatgaatgaggggcctggcgcttcgtgtctggatgtggtgatctggtgaggttcagatctttgatactttttgagaggcttgggggtcctttcctgaggaaggagctcaaataaaacaggtgtaagtttcaagctttaagactagaagtgtcaatttctatgtttatt

SEQ ID NO: 81904 - DNA, 422 bp, Homo sapiens
gcctaattaaaaatatacctaaagtatcaaggactaaattgtgtctttctaggtattatgtaactcagtatttactgaattacaattaacattactctctttatagaacccttgccaaaagtaacagttgaatgacattatctgaagcttataaacccatagctagagttattctctgctatgtcactcattctgtatattgtgtaggaaattccagttcgagtttagttgttagaaaagttttgcactgggctgggcgcagtggctcacacctataatcccaggactttgggaggccaaggcgggtggatcatttgaggtcagcagtttgagaccagcctgaccaacatggtgaaaccccatctctaccaaaaattagcctggcatcatggtgcacacctgtaatcatttccagctactgg

SEQ ID NO: 81905 - DNA, 798 bp, Homo sapiens
ggaaagtagagggtttaaaggagttgcatcggcagcggatgaagaggagaaggagactaagagcttgttgctttttgctataaaatttagcatttttgattttgcaaatcaagtgcatgtatttatttacacccaatgaagatgctatctgaatttttcatatttaaaagcatccttcaacatggttctatggagaaaaactgaaaattaaatttcaagttgaaaaattatttagagaacacattttagaatattgtctcaaaaaacaaagaagcatacaaatcccatttttcctcctcacttttaacatttgtgtataataatctattattctcctattttgtgagacaccattgtacatattgtgactattttgtgcagtacttgttttattttgacttgtgtttactactcccacgtagggcatcagcagtccccactctattatcttatcctcattcccttcctcatttatttttatcttacacttcgcctccattggtatttagcattctacatattatttattcagcatctgtttatttaatgcctactgcatagtaggtactgggaatgtagcaatgaacaagatagatatagccctcacctgcacaatctactgtctgtctggagctaatgtctgtattagctagggaatagcccacaaaaattttatttctaactgaaaattttatttcacctctggttgataagaccccacccatggctgggcgcagtggctcacacctgtaatcccagcactttgggaggctgaggcgggcggatcacaaggtcagg

SEQ ID NO: 81906 - DNA, 300 bp, Homo sapiens
taattttagcacatattttgaaggtgaaataacaggacttggttgcaagttgtgatggtaggggggtggcaggaagaagaaagcatcaaggatgatgatgctttctggaagaagcaaatgggtaaatggagataatttttacgaagaatggtaaggctgaagaagaaataaactaacaaaagggaaatgattgaggaagtggcatagatttgggggcagaactcaagagttttgaattctgattttaggaatgcctatgaaaatcccagtggagatttcaagatggcaggtgcacataat

SEQ ID NO: 81907 - DNA, 381 bp, Homo sapiens
gcggccgcctactactactactactactactaaattcgcggccgcgtcgaccaaatcattttggaaataaagattttttactacaaaaatgaaatttgtttggacttccacttgagacagtaaagagagtattagacacccagtaaaaactgccatataaagaagttgtaattgtttgttgtgtatgtatttttttcaatgccaaaccagctgtgatccaatttacatccacattttaggtccaacagcaagaagttcagagagagatttcccaaccagacattgggtcactcactggtcaccttgccagtgcattttattagaagggaatctgttgtagcaaatgggaataaacctgggtttctatagacccagaactga

SEQ ID NO: 81908 - DNA, 4896 bp, Homo sapiens
ggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgtagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaaagtcctcatgtagaagcacccacttttgcaatgttgttctaagctatctatctatctctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaagaagttgtaattgtttgttgtgtatgtatttttttcaatgccaaaccagctgtgatccaatttacatccacattttaggtccaacagcaagaagttcagagagagatttcccaaccagacattgggtcactcactggtcaccttgccagtgcattttattagaagggaatctgttgtagcaaatgggaataaacctgggtttctatagacccagaactgaaaaaataaacatcgtgctgtttttaatttgaac

SEQ ID NO: 81909 - DNA, 4863 bp, Homo sapiens
ggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgtagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaaagtcctcatgtagaagcacccacttttgcaatgttgttctaagctatctatctatctctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaagaagttgtaattgtttgttgtgtatgtatttttttcaatgccaaaccagctgtgatccaatttacatccacattttaggtccaacagcaagaagttcagagagagatttcccaaccagacattgggtcactcactggtcaccttgccagtgcattttattagaagggaatctgttgtagcaaatgggaataaacctgggtttctatagacccagaactga

SEQ ID NO: 81910 - DNA, 4772 bp, Homo sapiens
  misc_feature (4772)..(4772): n is a, c, g, or t
ggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgtagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaaagtcctcatgtagaagcacccacttttgcaatgttgttctaagctatctatctatctctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaaaaaaacaacagaaaacaaacaaaacagcagggggcgtagccggcgctctatagagaaagatatctctcgctctcaaagggggggggcgccccacaaagcgctataagcgcagcagaatcacccgcaagagctttatctccgtggtggcgacacacaaagggggggggcccccctatattagagggagacgacctcgagaan

SEQ ID NO: 81911 - DNA, 2925 bp, Homo sapiens
tatatgtggaccgagcctcgggacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaaagtcctcatgtagaagcacccacttttgcaatgttgttctaagctatctatctatctctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaa

SEQ ID NO: 81912 - DNA, 4393 bp, Homo sapiens
ggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgtagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaagaagttgtaattgtttgttgtgtatgtatttttttcaatgccaaaccagctgtgatccaatttacatccacattttaggtccaacagcaagaagttcagagagagatttcccaaccagacattgggtcactcactggtcaccttgccagtgcattttattagaagggaatctgttgtagcaaatgggaataaacctgggtttctatagacccagaactga

SEQ ID NO: 81913 - DNA, 3884 bp, Homo sapiens
ggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgtagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatgggaaagggcatgcccgtgggccctagagatgtctcggatatgccgaacatggccctccattaaggcgatagggaacagatgcccgggggacacaggcggaatcacatgtttgccacaatcccgaaagaggggggtgtcccgcaagggcgagcagagagagaggtccgcagtggatc

SEQ ID NO: 81914 - DNA, 1317 bp, Homo sapiens
  misc_feature (33)..(33): n is a, c, g, or t
gagggctgccgcggcgttctagaggatcccatnggtccttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaaagtcctcatgtagaagcacccacttttgcaatgttgttctaagctatctatctatctctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaa

SEQ ID NO: 81915 - DNA, 1171 bp, Homo sapiens
tgttgaaggaatgcatgggggggcttgggcagacttagcaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaaagtcctcatgtagaagcacccacttttgcaatgttgttctaagctatctatctatctctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaa

SEQ ID NO: 81916 - DNA, 498 bp, Homo sapiens
gtccctccaagaacaagggagcaaaagccctatctttgtatccaacatgttttaaatccttaaatgaattgctttctcccaaaaaaagcacaatataaagaaacacaagatttaattatttttctacttggggggaaaaaaagtcctcatgtagaagcacccacttttgcaatgttgttctaagctatctatctatctctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaa

SEQ ID NO: 81917 - DNA, 4571 bp, Homo sapiens
ggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgtagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaaagtcctcatgtagaagcacccacttttgcaatgttgttctaagctatctatctatctctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaa

SEQ ID NO: 81918 - DNA, 4786 bp, Homo sapiens
ggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgtagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaaagtcctcatgtagaagcacccacttttgcaatgttgttctaagctatctatctatctctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaaaaaaaaaaaaaaaaactcgagactagttctctctctctcctggtgctcatctgctggcaccgggcatccacccatcagcccccgccctgtccctccgaaggacacccagcaggcaccccccggggaggcaggggcagaggtca

SEQ ID NO: 81919 - DNA, 4842 bp, Homo sapiens
ggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgtagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaactatctctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaagaagttgtaattgtttgttgtgtatgtatttttttcaatgccaaaccagctgtgatccaatttacatccacattttaggtccaacagcaagaagttcagagagagatttcccaaccagacattgggtcactcactggtcaccttgccagtgcattttattagaagggaatctgttgtagcaaatgggaataaacctgggtttctatagacccagaactgaaaaaataaacatcgtgctgtttttaatttgaac

SEQ ID NO: 81920 - DNA, 2808 bp, Homo sapiens
cctccaaagccttcttgagtcatagagggagcatagaatgggtgatgacctggcaccaatcctgcctctgctgcttaccaaccacacgggctgaagtcagcctgcctctttggagcctcagtttcttcttctgtaaaatagcatgacacagcacctgctttgcatccctcataggcttgttgagatgttcaaaggagagcgtgaccatatcttgtttcagacatgtgatacactcatgcccatctgtgtcttgccagccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaaagtcctcatgtagaagcacccacttttgcaatgttgttctaagctatctatctatctctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaa

SEQ ID NO: 81921 - DNA, 2636 bp, Homo sapiens
ggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgtagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggtatggctcccaagtgtcagcctgggtggtctccaggacaggcagggttctgcactgggctaagtcttggacctgttaagtgggatcattacgtatagcgtacagctgtgcagaagcagcggcagaagtagcaggtgagagctcagagggtctccaggtaacaggatgcaacgcttacgtcgacggcgtgcctcagagcacgggactcgggggccagccaccagcttgcaagccgtggtcactcaaagtgcttgagaaggtgttcgtcgggcgcaagacggctgccctaccagttccatctgtccagcaacacatagcaaaggcggcccaagcaaaatccctttagtgaggg

SEQ ID NO: 81922 - DNA, 695 bp, Homo sapiens
aacatttctctggataatgagaaatcagacatggactacggggacaagacacaaatctaagaaccagcaggcccaggaccttctctggccatcaccttggaagatttgctgatctctgctttggcaagggatggcaggcagcctttaagggaggctgatttcaaacctctgtgcccatctaactagtttgagaagcttaccaagaaagcaagaatgtgtgagaacattcctacatacagagtttctcaactatagcgtttatcctgcccagcctcctcccttaacagaaccaggactccatttgcaattctgaaagagagttagctctggactgctaaactccagaaattgcctatgcctacaatatgcttttctatacctcctgtgctatacttagagacagaagaatttattactactattagaaggccttcttctgacaagggaagatagcttcaagtcaaaatataccttttatccccatcactttacagtcactagtcaatgactgttgttacactaaaatcaaaaggcctttggtgagctcagtgacagtgacctctgggacaatcacagaaatgacttcactgctgttctgaatgacaattcttaagtggctaggacaaagcaaaagcgagtataccttttgaaaagctgtctaagtggtatttccttttccattctgagaacgtaaa

SEQ ID NO: 81923 - DNA, 129 bp, Homo sapiens
gggaaatggataactgaggtttttccatttttatatggatatgctatatgtttaaacttgggagggaaattgataactgagatgcatggatattgactttatatctaatgctttagaatcttaaccaaa

SEQ ID NO: 81924 - DNA, 437 bp, Homo sapiens
tgtgaactctggattattttgcaatggactgcttacttagcaaacacattttgctgttggtttacagtgtacctgcactgtggcaggaaacagtttctgcaggacaggcttgaatatttttgagacttgctttacggtccagcacatgtaatgcccaggttcatcagcttttgttaatgttccaagggcttaggaagaatgcacttactgagtgtggcatcacatgaaagtccatttgggagagagagtcatcaacacacccagtatgattaagtaccaactaaagacaaaatgtgaaaggcaggtgtgtacctggcagaatctaataaagccctaatcccctacagccagaaggcagacatggcagagccccactcaggacttgtaaaggtgagcagagcctccaataagtggaattctcagctccaccaggcttc

SEQ ID NO: 81925 - DNA, 507 bp, Homo sapiens
acgcccatacacacatacacacacacatgcacacacacacacacatgtgcacacatgattactgggtcccactcccagagtttctgattcagtaggtctgggatgaggcccagtgatttgcctttcttacaagttgcccagtgatgctgatattgctagtgtgagatcacattttaagagccattgctctaggaagcctggagaaatacactcagaaaataggcaaaataaaggggcctaaacaataatcaggatcacaacctaagccctgccactggcctattttatcgaacctgcagtcactgctaacattgaacactgaatgctacagctcctgtgacagctgccacttaaggcagtctggaacactgcctgctggtgcccctgacactcctgccccagaactaattttaaaattattaaatctatttatatactatcttggtgcaacattacagtattgtaaacttttcgtctgtgttttgcattaaagttacattatctaaa

SEQ ID NO: 81926 - DNA, 504 bp, Homo sapiens
ggtgtctaccctggatactattttaccttcttaactggaattcttgtcacattagcagctagagcggtcaggaacaactacagacattacttcctttcttcaagagctctcaaggctgtgtatgatgcaggcacctgggccgtcactcagctggctgtctcttacacggtagcaccctttgtgatgttggcagttgaaccgaccatcagcttatacaagtccatgtacttttatttgcacatcataagtctcctgataatactatttctgccaatgaaaccacaagctcatacgcaaaggcggcctcagactctgaactctattaataagagaaaaacagattgatacctccaagagaagcggaacaagcaaaactgcagaacgttcgaaagatgagatgacaaggcttcaagggctcctccggtggcttagaggcgatgtttacatgcatctttattttgttcttttttaaagtgcagggagtattttttttttttttttttt

SEQ ID NO: 81927 - DNA, 337 bp, Homo sapiens
tagtagagacggggtttcaccatgttggccaggctggtctccaactcctggcctcaggtgatccacccatctcggcctcccaaagtgctgggattccaggcgtgagccaccgcgcccagcccctgcaatacgtcaacagtccctagattcaggcaacatggagttgcagccaaggaactttgaggtagtgaccaatgcagggaggtctgacagagaatcagcaggatccatttcatggccaccacacatctgactgactccttcttgggctaagcaaatacttttgtgggcagtgacactggcagctgctggggtcttggcaggaggttggatggag

SEQ ID NO: 81928 - DNA, 744 bp, Homo sapiens
actttgcaggtgagaacagtgaggttctgatagccccggacactagcacgcccttaggtggtgccagagctgggatctgaatctggctcatccatccaactctatggcctcagcaccttcacccccttggaagggactttagggagacacggggagtggaggggtatcctggggacacgacgggatgtggctgcagcagacctgccggtgaatccttctgactcaccgtgtgaccgtatgtgaggccttccccggtgagcctcagttcctgggctggacgctggggagagccgtctccaccctgtctgcctcccgaacagcttgctctggaaactcccataggaggcatttgtgcgtaggtggctgtggggtgagaggagcattgctgatcattatttaagcaaagatgacactgggcagaagggggcagcgagcccattcctggggaaacaggatgcatcccagcctgcgctctcccccctcagtcagctaatctccccaggccgacgctgctcctcctcccgattccatctgcctcttaaacgcgggacttctcactgaaacgtattcaaacccgaacatgcactaagggaacttcagacaggaggagaggcagcaggttgagctcttggggtccctggcgaggcagacgctgcgggtggagacagtccttagtttgtcctcggtgccaccacccctgtggtacaagagacactgaagcagctgtatggggtggcagctcca

SEQ ID NO: 81929 - DNA, 565 bp, Homo sapiens
tgtggagacagggtttcactatgttgcccaggctgttctcaaactcctggcctcaagcaatcttcccaacttagcctcccaaagtgttgagattacgggcgtgggccaccgcacccagcgcaagatttcatttttaaacaacaggaaaatcctagggcaaaaatagcttacaaaaaatagtttgtatagtgagtagggagccatgcatagtttttaagtgggaggaatgacatgctcagatttggattttagaaagatgttctggtagctgtggcaaatggactacactgggcaattcttttcttttcttttcttttctttttttttttttttagtcagagtctcaccaggtgggccaggcgggtctccggacctcaggtgattggcccgcttgggtctcccaaagtgctaggatcacgggtgtgagccacaatgcccattatgaattagggatatacacgggtcatgaagactatgcatgggaccaattccagtgaaaatttcacaagctgacaatacagaaaattatgccagtgttccccactccatatttctcctacagggg

SEQ ID NO: 81930 - DNA, 351 bp, Homo sapiens
ctccccactaacagtgttttagtgaacaatttacaatcttattttaaaattctatcctgatgattgtagtggtcaggtgatcagcctcctcagagtttggaattgacacaggtttggctgttgatttttaatggcccataacaatgacttgttagctgctttaacatcgagatgtccttggtgtttatttcttacatgtgtgtacctcagtcacaaaatgcactctcctgtttttatgataattaaccgagaaaccatcccatagatctggcagtttcaacagagttggagtgtgctgttagggtaaacaatgttccatattctcccaagcaggcagaagataaaggtggg

SEQ ID NO: 81931 - DNA, 555 bp, Homo sapiens
ggggaggcggcggcgcggcggcggggggcgcccgcaagcccgcggctctgagcggccacccgcgcacaatgttgggcgagttggcagccgcctgcacctgcctcctggccccggcccctgattccgcctccggccccaagcgcccgggttgcgccctcggctgcctcgcgaggtagccccaggaggcctaggggcccgcctgcgcccccggcgccagaccatggtgggcagctccggccaggagcctcagccgccgcgagccaacatcgcctgcagccagcccccgccccacccgagcggacgcgcgggtattcgcagcgcgcgggtcacttccttcctcggccgggatgggcggcgcgggactgagtgatcggccttgcgtccggcgggtaatccccatctgatctgctgcctgtgagctgctgactgccggggcgcgcgacctagggggcacgggcagcagcgcggcgatgacctgatcccgagcccgccaggggccccttccttccctcccttccctcgctccctctgagcctgtgcggagaccagctcggt

SEQ ID NO: 81932 - DNA, 2713 bp, Homo sapiens
  misc_feature (122)..(122): n is a, c, g, or t
  misc_feature (2711)..(2711): n is a, c, g, or t
ggagccgcgccgcatctcaggcgcagtctctaggggctgtgcgcatcctagggggggacatgtgcatctcaggggggctgctcgcatctggggggtgctgtgtgcatctcgggggggctgtngcatctagcggggtggctgtgtccgcatctggagggggctgtgcgcaacccggggggggtgttgcgcgcatctagcaggggcggctgtgcgcatttcgggggggggctgtgcatatctggggggaccgtgcttatctctgggggcggctgtgcgcatcttgaggggtgtgtacatctcggggggcctgtgcgcatcttggggggctgtgtgcatccgcgggggctgtgcgcatctcggggtgctgtgcgctgctcctctgagctctgctctttcttgcagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccagggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggagggaattccctgtattagtctatatggttctccaagaaactgaatgaatccattggagaagcggtggataactagccagacaaaatttgagaatacataaacaacgcattccgcaggaaacatacagaggatgccttttctgtgattgggtgggattttttccctttttatgtggatatagtagttacttgtgacaagaataattttggaataatttctattaatatcaactctgaagctaattgtacataatctcgagattgtgtttgttcataataaaagtgaagtgaatntg

SEQ ID NO: 81933 - DNA, 347 bp, Homo sapiens
aaaaaaaaaaaaaaaaaaaaaaaattcaattgttattattatgtaaaaaaaaaaaaaaaaaatgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81934 - DNA, 267 bp, Homo sapiens
gcggccgctactactactaaatgggcggcgcgcaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81935 - DNA, 456 bp, Homo sapiens
tagggaatttgcctcggaggccaagaattcggcgacgtaggtgatccacccaccttggcctcccaaagtgctgggattacaagcgtgagccactgcacccggcctatttgcctgtttcttaattgaattactggcttcagggtggaccccagggccaggaaagcatgtagtttttatggcctaataagcaaacacagttggaaggcaaaatagctcccccaaaattaagggtcccagttttatatcagattctggatcctaaaaagagggaatcagcccatccccaaaaggacatttcctacctagttattacacaccagaactgtctcataatctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81936 - DNA, 2993 bp, Homo sapiens
gaccaggggggacagcacttctttcagtacattttcctgttagactcggggtattagagacccaaagatacccaaggaggagtgagagcgtccctgccttcgaggagcagacagggcaccgcgaggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccagggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81937 - DNA, 3049 bp, Homo sapiens
  misc_feature (23)..(24): n is a, c, g, or t
aaacctataggctaggtacgagnnccgggtggttctttccttgcaccctcaccgcatatggaactcctggcgtcgtgtcccaggtcacgcctgtccccgtggggaggctgggcccctccccccagccactcccgagacttgagacctctgcctcaggacgatgggtgggaaggggcttgcggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccagggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81938 - DNA, 2931 bp, Homo sapiens
gtgaagatctgcgggtcatgctgtccctaatgcgctgattgcattaagtggattctggctgcagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccagggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81939 - DNA, 2841 bp, Homo sapiens
gaccaggggggacagcacttctttcagtacattttcctgttagactcggggtattagagacccaaagatacccaaggaggagtgagagcgtccctgccttcgaggagcagacagggcaccgcgaggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccagggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81940 - DNA, 2821 bp, Homo sapiens
ccgccgcccggttgccatggcgacgccgtcgcgccacggcccgcagaaccggccaagcgacccgggcgcggcgcggggaggctgaagggacgctcgggtaggcaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccagggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81941 - DNA, 2247 bp, Homo sapiens
atcgtatctttccaaagtgcagacaaaacaggcatcttcatggtaattttttttaataaataaaagcacggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccagggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81942 - DNA, 1343 bp, Homo sapiens
attcggcacgacccctgtcgcccaggctggagtgcaatctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81943 - DNA, 1815 bp, Homo sapiens
gaccaggggggacagcacttctttcagtacattttcctgttagactcggggtattagagacccaaagatacccaaggaggagtgagagcgtccctgccttcgaggagcagacagggcaccgcgaggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81944 - DNA, 1129 bp, Homo sapiens
gagcctgttttccaggatggagtgcaatctcagctaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81945 - DNA, 466 bp, Homo sapiens
cccctctgttcttcctaatttgtagctaatcagattctgcctgcagccaggctctctggggatgaatctaataaaggaggcggcgacctggagaggaggacagacaacaagtgaccaggggggacagcacttctttcagtacattttcctgttagactcggggtattagagacccaaagatacccaaggaggagtgagagcgtccctgccttcgaggagcagacagggcaccgcgagggtaaggaggctccgggagagcctggggacagagtgatctgcgcaccgcggtgcctgaggagtggaggcaggggtgtgggcccacagcagggagccaggctgggccatgtccttggattctgtgagcccaggcgtctcctctagagggcctagcaggaacagtgggggctgcagatggaaacgggcaggatcatgccatgcagttggcatttcactggcactcgggggc

SEQ ID NO: 81946 - DNA, 2650 bp, Homo sapiens
  misc_feature (122)..(122): n is a, c, g, or t
  misc_feature (2648)..(2648): n is a, c, g, or t
ggagccgcgccgcatctcaggcgcagtctctaggggctgtgcgcatcctagggggggacatgtgcatctcaggggggctgctcgcatctggggggtgctgtgtgcatctcgggggggctgtngcatctagcggggtggctgtgtccgcatctggagggggctgtgcgcaacccggggggggtgttgcgcgcatctagcaggggcggctgtgcgcatttcgggggggggctgtgcatatctggggggaccgtgcttatctctgggggcggctgtgcgcatcttgaggggtgtgtacatctcggggggcctgtgcgcatcttggggggctgtgtgcatccgcgggggctgtgcgcatctcggggtgctgtgcgctgctcctctgagctctgctctttcttgcagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccagggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctacggaattccctgtattagtctatatggttctccaagaaactgaatgaatccattggagaagcggtggataactagccagacaaaatttgagaatacataaacaacgcattccgcaggaaacatacagaggatgccttttctgtgattgggtgggattttttccctttttatgtggatatagtagttacttgtgacaagaataattttggaataatttctattaatatcaactctgaagctaattgtacataatctcgagattgtgtttgttcataataaaagtgaagtgaatntg

SEQ ID NO: 81947 - DNA, 2973 bp, Homo sapiens
ccgccgcccggttgccatggcgacgccgtcgcgccacggcccgcagaaccggccaagcgacccgggcgcggcgcggggaggctgaagggacgctcgggtaggcaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccagggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81948 - DNA, 3082 bp, Homo sapiens
tgcggccgcgcactggactgcggcgccgacccgcaccctgggcccgagggctgcagggctcgcccgccctctcggagccgagcctctcccggtccaggcggcccctgccctggcctgcccgggtgccgggtctctgctgaagttagaaccgagacccccgcttgctggtgaccccgagtttggatctttgctcctgcgccgcgttctagagcaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccagggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81949 - DNA, 2808 bp, Homo sapiens
cttgctaggagtaggaccatctgcccaggcttaggtgggggcctgtgtgaggagccacgtggctaacaggtgaactcagaggctgcttgttgcctcagtgtgaccaacagtggacctcaaacacagcctggaatttgcaggacacctgacaagaagccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccagggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcaga

SEQ ID NO: 81950 - DNA, 3545 bp, Homo sapiens
gaccaggggggacagcacttctttcagtacattttcctgttagactcggggtattagagacccaaagatacccaaggaggagtgagagcgtccctgccttcgaggagcagacagggcaccgcgaggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccagggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcagaaaaaaaacacaacggagaagagacacgaaacaaacaaacatttgtgtgggcgcgcactgggcccgagaaaagtttttataacaccacccgtgtgggggcgccgggccccaaaagttatagggcacacatgggccaaccggggcccaaggagaccccgcgccctagacaaagcgggtggggttccccccaatatagaaacgcgccgggggcaaccggggtttggaacaaactccagagggagttcggagggcaacaggggttctaacaaggggggcgccagggaaggccgaaaaaaaatacgccggaccggcggggagacaccgaaaaaaaagaaacagacgaagagaacaggcagaaagagacgaaaggaaatgacgtggccaggtaagcatcgaacgagacagacagagtgaagcagaaatggacaagaacaaagtcacacaccgaaaggaggaaaaacacacagaggagcgaggagcaagaaagaaggacacacagagaaagaaagaagaaaagaacacaacagagagagaacaagagagtaacaatatt

SEQ ID NO: 81951 - DNA, 3404 bp, Homo sapiens
gaccaggggggacagcacttctttcagtacattttcctgttagactcggggtattagagacccaaagatacccaaggaggagtgagagcgtccctgccttcgaggagcagacagggcaccgcgaggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccagggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagagaagacgacagaaggggatttgtggtgggttattttattttgcctgtggccaatcttctgtgaaatacaatgtgctgttggtgcaacagatgattcaataaatgtctacagcagaaaaaaaaaaaaaaaaaaaaaaaaaagtcgtatcgatggtcgaccgatcatgatggatgatgttcaacccgggaatttcccgacccgttcccctggaggccgtacccaagttttcccttatgatgaagtcgtattaaaaacttggggcgtaatacatggggcattaacctgtttccccccgtgggaaaaaattgtgttttttcccttttcccacattttccccaaaaaaatatttattgaaaacccccggggggcccttaataaaagtttgtaaaacccccccgggggggggccccccttttgggggggcgggggccccaccccctcccactttttttttgtggcgtgggcgcctccttttctccccccccctttttttttctacccggggggggaaaaacactcctccccg

SEQ ID NO: 81952 - DNA, 609 bp, Homo sapiens
gaccaggggggacagcacttctttcagtacattttcctgttagactcggggtattagagacccaaagatacccaaggaggagtgagagcgtccctgccttcgaggagcagacagggcaccgcgaggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcaggtgagtccttccaacaccccgggcctggggccacctaccagggaggtgggaggaggaggggagct

SEQ ID NO: 81953 - DNA, 1049 bp, Homo sapiens
gacttcccacattttattttattagctttttacctcttatatttaagtctttatctggagtttacttctgaagatgatgtgaagcatgcgtctaaacggaagagtgtgatgctctcatcaagtccatgctggtcataggtgtgtcggtattgcagcttgtgagaaggtcaggcacacccagagaagtgcacagaccaggaagtgggatttgtcacttccctcgtgttctactgaattcatggattgacaggagcaattgccagtggaggaaacaagaacataaacagatgtacaccaagcgcactatggaacacttttaatttcctggagacagtatttcttatggcactggcagcctttcctccctgccttgtcaggatcttattaatgtgctgacagattcctttctctcaatgtacctgctgggtgagagctgctattatatggaacacagctacccattatcttctaaatggccttcagaaatgatggagaaactgacacgttatgagtatttcctgccctacatggattttgaacttgaattcccagcctcgcttgcatctagacacagagagaaccaactggaaataacttctttgctgccttaaaccagcagactttattttaggacagagtgagtagtttgttgctaacaactttgggggatactggagaaggaataacccgaaaaggtcctgcatgaggctttgaaattataaagaacttacagcttctgcttgatgatgactcaacagttagagtggggaaggtaaaagtttagtgagctggtggctaaataatcaaataattttggcagtgataagggacacaatagaggtctaaaagtaggcataatgggagcacagaggaagctcttgagtcgtttggagatgtcataccagtgatggcttgcaggagaggatagctgggctgagccttaggaaacaagtagaaatttgcttaatatacaggtggagtaggagtagtacattccaagcaaagtaaaatggagagagagagagagagagagggagagagaaagagag

SEQ ID NO: 81954 - DNA, 395 bp, Homo sapiens
ttcatttagcacgcatttattaaatttttcatgtcttccaggtcctgcatgaggctttgaaattataaagaacttacagcttctgcttgatgatgactcaacagttagagtggggaaggtaaaagtttagtgagctggtggctaaataatcaaataattttggcagtgataagggacacaatagaggtctaaaagtaggcataatgggagcacagaggaagctcttgagtcgtttggagatgtcataccagtgatggcttgcaggagaggatagctgggctgagccttaggaaacaagtagaaatttgcttaatatacaggtggagtaggagtagtacattccaagcaaagtaaaatggagagagagagagagagagagggagagagaaagagag

SEQ ID NO: 81955 - DNA, 323 bp, Homo sapiens
  misc_feature (279)..(279): n is a, c, g, or t
  misc_feature (317)..(317): n is a, c, g, or t
tgtgaagctgcttgttcccacccaattccctccagagatggtgggtgctgcccatcgtgcacaggctgttttcacagtggtgtcgtccgagctgaaggggatgtgttttcacctcccaatgagaactgcaccgtctgtgtctgtctggctggaaacgtgtcctgcatctctcctgagtgtccttctggcccctgtcagacccccccacagacggattgctgtacttgtgttccagtgagatgctatttccacggccggtggtacgcagacggggctgtnttcagtgggggtggtgacgagtgtaccacctgtgtttnccagaa

SEQ ID NO: 81956 - DNA, 113 bp, Homo sapiens
ctgtttctcacagggcagggagaagaggaatctgccagcctttggatcagcgtctgtcccatgggcaaagcctttatccagcaagaagccagctgtgtggcaagcaatggagg

SEQ ID NO: 81957 - DNA, 412 bp, Homo sapiens
ctactaaaaacacaaaaaattagctaggtgtggtggcatgcacctcaggggttctgagggatgagtaggagtttcccaggtagatgggtgttggaaggctattccaaggagagggatgaaaaataaagcttcacaaagttgttcaggactggaccaagagtaggagtcaggggagaggtagaagtggctgctgagaaaccaggcagatgtgagatccaaataataaaacccagattcaatagaaaaaaattagctgggcatggtggcatgtgcctatagtcccacctactggggaggctggggcaggaggatcacttgagcccgggaagtcaaggctgcagtgagctgtgattgcaccactgcactccagcctaggcaagagagcaataaatcttaaataagatttattatc

SEQ ID NO: 81958 - DNA, 543 bp, Homo sapiens
ctactaaaaacacaaaaaattagctaggtgtggtggcatgcacctcaggggttctgagggatgagtaggagtttcccaggtagatgggtgttggaaggctattccaaggagagggatgaaaaataaagcttcacaaagttgttcaggactggaccaagagtaggagtcaggggagaggtagaagtggctgctgagaaaccaggcagatgtgagatccaaataataaaacccagattcaatagaaaaaaattagctggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcaggcgcctgtagtcccagctacttgggaggctgaggcaggagaatggcgtgaacccgggaggcggagcttgcagtgagccgagatcccgccactgcactccagcctgggcgacagagcgagactccgtctcaaaaa

SEQ ID NO: 81959 - DNA, 779 bp, Homo sapiens
tggcctccttacccccagtggcagaagggaggaagggaggtcccctgtggcctcccatccttgtgctcccattagggtcagcatgaagcaggaatgaggctgtctatatcatcatggcattcccaacactaaactctgtgcccaggagaagttctgcaggctgtacaggaagcatgaattggaggcctcaggaaacttacaatcatggaggaaggacgaggggagcaagtacatcttgatatggcagagcaggagagagagagaaggggaaatactacgcacttttaaacaaccagaactcacaagaactcactcatgatagtgaatcttaagaacagcaagaaagaaatctgcccccacgatccaatcacctcctaccagcccctcctcagcatgagatttgggtggggacacagagccaagccatatcaattcctcaataccagggtcaggcttccctgggaaccaagtccatcatggatcaggacaggaccaggaacacagcacccactgtgtctgaccaaagagcctcaactgccagatgtctgtccatccacaccattcaattagcacctactatgtgccagccttaggtctaggggctcaaaaacagggtggacaagacaggaagtgtccctgtcctcatggaccagacaccatctggtggaagagatgagacaattgagtaataatatcaatacaataagatgtcatcacttagtgaggagaggagaggagagctcagtaatggtggtagaggagccatcagagggttggac

SEQ ID NO: 81960 - DNA, 442 bp, Homo sapiens
taagccagagacatttcactgtattaatcttgatactaattactaaggcttttctgtggacattaaatttgatctgtttaattgcaaatacaataaaagtcgtgatttatgcttaatgtttctgctaggctgatgacattttgaaaatggcacttatagcctggtttgtcttggttacaacttttgtggctccagatgctaaaaaaaatctaattgagtaagtaaataatgcagctaagcgtgcctctctcgcttccgaaaagttttttctactcctttttctccctggagaggccctgctgcacactgatgctgatctaaggaaatgcctttgcttctttgccactgagcaatgttagaatcatcttagagggcagggctatcccactggtcactctgtcccagcatatctaccatgaagtcagcagggactacaaactcc

SEQ ID NO: 81961 - DNA, 440 bp, Homo sapiens
aagctgcctcctgcttgggatgctcctcctcagtccctcccctttaagagccagccttagtcttccaggaagccttctcctgccccttcagacctctcttgcttctcttttcatccacacattcagacctgggaagaggcagctgatccaggagaacacccaccctgtggggtggggacactgcttcctggtcctatctgtgactctgtgtgaccataggcaggtgtctgcctcattttggttctgtttcttcatctataaactgggaagaataatacatgttctacctaataccagattggcttttttttcttttttagtagccacacttctccatccatggatgtcggccccctaggccgaagagcagagagagaagcgcagacggaggaacccaccacgcaagcaggcaggcagcaagtgagtggtgtgtctggggg

SEQ ID NO: 81962 - DNA, 1238 bp, Homo sapiens
agctgagtgtgcgagcgccaggggttccagctgcacgtcccaggctctccagcgcgcggcaggccggggcgggacgaggagagctgcggggacaacgcctgtggtgggtccggaggtgcgggtgcggcgcgggacaagcgggcagcatgctcagggcggtcgggagcctactgcgccttggccgcgggctaacagtccgctgcggccccggggcgcctctcgaggccacgcgacggcccgcaccggctcttccgccccggggtctcccctgctactccagcggcggggcccccagcaattctgggccccaaggtcacggggagattcaccgagtccccacgcagcgcaggccttcgcagttcgacaagaaaatcctgctgtggacagggcgtttcaaatcgatggaggagatcccgcctcggatcccgccagaaatgatagacaccgcaagaaacaaagctcgagtgaaagcttgttacataatgattggactcacaattatcgcctgctttgctgtgatagtgtcagccaaaagggctgtagaacgacatgaatccttaacaagttggaacttggcaaagaaagctaagtggcgtgaagaagctgcattggctgcacaggctaaagctaaatgatattctaagtgacaaagtgttcacctgaataccatccctgtcatcagcaacagtagaagatgggaaaaatagaatatttaccaaaatatctgccatggttttattttggtaacaagaagcacaatgtcttttttatttttattttttagtaaacttttactgaagtataccatgcattcaaaaagtggacaaaactgtatacagtctgatagatatttatgtcgtgaacacctgtgtaaccactgccaaagtgaagatgtagaatattggcaacacttcacagcctcattcctgccttttctcagccattacctcccaaacatagcagtttttctgagtttcatcacctttgattcattttgcctgtttttgaactttatataaatggatttatacattatgcacttgtgtgtgtggattatttacctgacagttataaggttaatccacaaattgtgtgtaccattagttcatccattgtcattgctgtattctgttgtataaacataccacaatttattttgatatttggcacagtttctggccactacatataatgctaaaatgagcacattgtatatgtcattaaaatgaggttgaact

SEQ ID NO: 81963 - DNA, 1035 bp, Homo sapiens
agctgagtgtgcgagcgccaggggttccagctgcacgtcccaggctctccagcgcgcggcaggccggggcgggacgaggagagctgcggggacaacgcctgtggtgggtccggaggtgcgggtgcggcgcgggacaagcgggcagcatgctcagggcggtcgggagcctactgcgccttggccgcgggctaacagtccgctgcggccccggggcgcctctcgaggccacgcgacggcccgcaccggctcttccgccccggggtctcccctgctactccagcggcggggcccccagcaattctgggccccaaggtcacggggagattcaccgagtccccacgcagcgcaggccttcgcagttcgacaagaaaatcctgctgtggacagggcgtttcaaatcgatggaggagatcccgcctcggatcccgccagaaatgatagacaccgcaagaaacaaagctcgagtgaaagcttgttacataatgattggactcacaattatcgcctgctttgctgtgatagtgtcagccaaaagggctgtagaacgacatgaatccttaacaagttggaacttggcaaagaaagctaagtggcgtgaagaagctgcattggctgcacaggctaaagctaaatgatattctaagtgacaaagtgttcacctgaataccatccctgtcatcagcaacagtagaagatgggaaaaatagaatatttaccaaaatatctgccatggttttattttggtaacaagaagcacaatgtcttttttatttttattttttagtaaacttttactgaagtataccatgcattcaaaaagtggacaaaactgtatacagtctgatagatatttatgtcgtgaacacctgtgtaaccactgccaaagtgaagatgtagaatattggcaacacttcacagcctcattcctgccttttctcagccattacctcccaaacatagcagtttttctgagtttcatcacctttgattcattttgcctgtttttgaactttatataaatggatttatacatta

SEQ ID NO: 81964 - DNA, 789 bp, Homo sapiens
cacacaggctggaatgcagtggcacaatctcagctcactgcagcttcgacctcctgggctcaaaggatcctcctgcctcagccctccaactagctgggaccacaggcatgcgtcaccacacctggctaattttttgtattgtttgtagagacggggtttgccatgttgccagggctggtttcgagctcctgagctcaggtgattcttgtgcctcagcctcccatgtagctgggattacaagagcatgccaccatgcccagctaatgtttgtatttttagtagtgtcagggtttctccatgttacccaggctgctcttgaactgggctcaagtgatccaccagccttggcttcccaaagtgctaggattacaggcgtgagccaccgcacccggccagaataatatttatttatttatttatttttgagatggaatttcactcgtcacccaggctggattacagtgacttaatcttgtctcactataacttctgcctcccaggttcaagcaattctcttgcctcagtctcccaagtagctgggattacaggtatgcaccaccattcccagctaatttttgtatttttagtagagacgcggtttcaccacgttgccaggctggtctcgacctcttgacctcaggtgatccacccacctcggcctcccaaagtgctgggatgacaggcatgagccaccatgccccgcgcagaatagtggttttaaatgcattagataatatataggaatgcaaagtgaaacaattatattagtatgccattatcaaattataa

SEQ ID NO: 81965 - DNA, 377 bp, Homo sapiens
aattttagttacattcgatatcagatgaaggaaatgtttagagggctccagatacactctgggggcagaaaccttaggagtgagaactaagaacgttgtgtcaatacaatgtatcttccaaatacaaatatggaactcttgtttaggcaggccaacaggagggagcaccttgcctagctgaggctggctcagagagtcccagctttgctactctgtatcctcactgtccttccaatctttactaagcttaattgcagagtacagcatagggatggggaaactggattgtcccagttttatctgaactattgctcagactaaaggatgtttgttttaaagtgttccttctagcttcccctttctgaatttttattgtt

SEQ ID NO: 81966 - DNA, 419 bp, Homo sapiens
cggccagtgtgggtgccgaggccgaggaggcacccagagtgagcgagggctcccaacatgctgtcatctctcaaaaccgtatcactttccaactagactgttcaccgaagaagtagattccatactgctgtttttctttgtaatctgtcttgcctcttttcttcattccctgcctagagaagacaggacccagggttccaacataacaggtgcttcataaatgctgactgagaactttcccaaacttggaccctttattgctatagtttactaacattgttcagccatttgtcatccatttgaatttgccacactacgtgcagaaatatgcttactccattcgtgtggcatcaggctgcctcggacactggagtgcagcacgcattgtgggtaataaaatgaatttgttgactcctagg

SEQ ID NO: 81967 - DNA, 540 bp, Homo sapiens
tggagacaaactgagaagggccttgtcaatgaagttaaagaactgagattttatcccttagaaaagggaatactcttctgagggttttaataatctgaggttttaaaaccaaagagaaagaacatatctgtgttaatgctggtagcagtgcaaatgataggctagagctggggagatcagttagaaaattctaagcaatattccagataggagatgacatgaattcagcctccagaaatgaaaaaaatgttgagactgactagatgtaggagataagggagtgaagctgactgaggtttttagcctaggacactaggtagcgattttatgcctttttgtatcatctacctgtgttaggcatacagtaaacaacagtcttcaattttcacaagctaaggcattggctaaagtgctcatctaggcccaggaatattccttggtgccctggcaacaggtaagctaatttgctgggacttgatccatttaccacccagaatggctgcctcagatgcctcagccatcactgcctgtgttccccag

SEQ ID NO: 81968 - DNA, 383 bp, Homo sapiens
  misc_feature (297)..(298): n is a, c, g, or t
tggagacaaactgagaagggccttgtcaatgaagttaaagaactgagattttatcccttagaaaagggaatactcttctgagggttttaataatctgaggttttaaaaccaaagagaaagaacatatctgtgttaatgctggtagcagtgcaaatgataggctagagctggggagatcagttagaaaattctaagcaatattccagataggagatgacatgaattcagcctcccttgttcccggaaaatcgctgttattctgttctttttcaaggtgcactgatttcatattgtttnnacacacatgcttcacaatcaatgtgtacaatagtggtcctgacgtgatatacatcctcagcttacgaagataacaggattaagag

SEQ ID NO: 81969 - DNA, 457 bp, Homo sapiens
actccttggctacagagcacatggagggaacagatggagtgaatatggagtgaacacccagtcttttctgtggccctcaccccggtttgccctcctttccccatgctccagccacactggccaaattccagatgctcaaaggttctgagctccgcctgcctcaggccttcccacatgctgttccctctctctgaatcactctcttctccctcctctcctcagctgaaatgttgctccccagacctctctttttaaccactcctgtgtttttcttcttagtacttactacagttacagtttattacattctcatgtagtttcttaatgtgtgtctttaccattgacaatagtctgctgggggcagctgtcttgcttacccgagggtactgtgcttcctggagtccagttagctggtcatgcatatttgtttaatgaagttggctggaccggcagggtt

SEQ ID NO: 81970 - DNA, 3854 bp, Homo sapiens
  misc_feature (1125)..(1125): n is a, c, g, or t
agccacctgcagcgcgaggcgcgccgctccaggcggcatccgcagggctgggccggcgcggcctgggggaccccgggctccggaggccatgccggcgttggcgcgcgacggcggccagctgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgatgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagnaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaaggccttctcaggctggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacagaattgcccattattgaattatttacatggtataattagggcaagtcttaactggagttcacgaaccccctgaaattgtgcacccatagccacctacacattccttccagagcacgtgtgcttttaccccaagatacaaggaatgtgtaggcagctatggttgtcacagcctaagatttctgcaacaacaggggttgtattgggggaagtttataatgaataggtgttctaccataaagagtaatacatcacctagacactttggcggccttcccagactcagggccagtcagaagtaacatggaggattagtattttcaataaagttactcttgtccccacagtcccc

SEQ ID NO: 81971 - DNA, 2570 bp, Homo sapiens
  misc_feature (1125)..(1125): n is a, c, g, or t
agccacctgcagcgcgaggcgcgccgctccaggcggcatccgcagggctgggccggcgcggcctgggggaccccgggctccggaggccatgccggcgttggcgcgcgacggcggccagctgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgatgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagnaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaaggatgaattgaatatgaaacccaaaaaggcttggaggaggagaaggcttgtatgtgcctacacattggaggatctcctgctctgcatatatcagtgcccagggtggggattctcgagtattagacgtcgtgtgtacacagtaccctgcgccagagcgcgctctctcaacgacggcagtagtagtagagtagtg

SEQ ID NO: 81972 - DNA, 4039 bp, Homo sapiens
  misc_feature (1125)..(1125): n is a, c, g, or t
agccacctgcagcgcgaggcgcgccgctccaggcggcatccgcagggctgggccggcgcggcctgggggaccccgggctccggaggccatgccggcgttggcgcgcgacggcggccagctgccgctgctcgttgttttttctgcaatgatatttgggactattacaaatcaagatctgcctgtgatcaagtgtgttttaatcaatcataagaacaatgattcatcagtggggaagtcatcatcatatcccatggtatcagaatccccggaagacctcgggtgtgcgttgagaccccagagctcagggacagtgtacgaagctgccgctgtggaagtggatgtatctgcttccatcacactgcaagtgctggtcgatgccccagggaacatttcctgtctctgggtctttaagcacagctccctgaattgccagccacattttgatttacaaaacagaggagttgtttccatggtcattttgaaaatgacagaaacccaagctggagaatacctactttttattcagagtgaagctaccaattacacaatattgtttacagtgagtataagaaataccctgctttacacattaagaagaccttactttagaaaaatggaaaaccaggacgccctggtctgcatatctgagagcgttccagagccgatcgtggaatgggtgctttgcgattcacagggggaaagctgtaaagaagaaagtccagctgttgttaaaaaggaggaaaaagtgcttcatgaattatttgggacggacataaggtgctgtgccagaaatgaactgggcagggaatgcaccaggctgttcacaatagatctaaatcaaactcctcagaccacattgccacaattatttcttaaagtaggggaacccttatggataaggtgcaaagctgttcatgtgaaccatggattcgggctcacctgggaattagaaaacaaagcactcgaggagggcaactactttgagatgagtacctattcaacaaacagaactatgatacggattctgtttgcttttgtatcatcagtggcaagaaacgacaccggatactacacttgttcctcttcaaagcatcccagtcaatcagctttggttaccatcgtagnaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacagcatatccaagttttgcaatcataagcaccagccaggagaatatatattccatgcagaaaatgatgatgcccaatttaccaaaatgttcacgctgaatataagaaggaaacctcaagtgctcgcagaagcatcggcaagtcaggcgtcctgtttctcggatggatacccattaccatcttggacctggaagaagtgttcagacaagtctcccaactgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggccccttccctttcatccaagacaacatctcattctatgcaacaattggtgtttgtctcctcttcattgtcgttttaaccctgctaatttgtcacaagtacaaaaagcaatttaggtatgaaagccagctacagatggtacaggtgaccggctcctcagataatgagtacttctacgttgatttcagagaatatgaatatgatctcaaatgggagtttccaagagaaaatttagagtttgggaaggtactaggatcaggtgcttttggaaaagtgatgaacgcaacagcttatggaattagcaaaacaggagtctcaatccaggttgccgtcaaaatgctgaaagaaaaagcagacagctctgaaagagaggcactcatgtcagaactcaagatgatgacccagctgggaagccacgagaatattgtgaacctgctgggggcgtgcacactgtcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccagcatgcctggttcaagagaagttcagatacacccggactcggatcaaatctcagggcttcatgggaattcatttcactctgaagatgaaattgaatatgaaaaccaaaaaaggctggaagaagaggaggacttgaatgtgcttacatttgaagatcttctttgctttgcatatcaagttgccaaaggaatggaatttctggaatttaagtcgtgtgttcacagagacctggccgccaggaacgtgcttgtcacccacgggaaagtggtgaagatatgtgactttggattggctcgagatatcatgagtgattccaactatgttgtcaggggcaatgcccgtctgcctgtaaaatggatggcccccgaaagcctgtttgaaggcatctacaccattaagagtgatgtctggtcatatggaatattactgtgggaaatcttctcacttggtgtgaatccttaccctggcattccggttgatgctaacttctacaaactgattcaaaatggatttaaaatggatcagccattttatgctacagaagaaatatacattataatgcaatcctgctgggcttttgactcaaggaaacggccatccttccctaatttgacttcgtttttaggatgtcagctggcagatgcagaagaagcgaaactgtggaaaatccctgagacaatgaaagcagttaaaattgcaccgcagagggaaaacccaccacagaggatgcctgggaaaaacaaggacaagggtaacacaaaggcagcaagaagtcctgggacactgcagaagttctgaagcaggagcagccacatggtgaaatcaacataagattaaatatgtatcagaatgtggatggccgtgtttcggaatgtcctcacacctaccaaaacaggcgacctttcagcagagagatggatttggggctactctctccgcaggctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaaggccttctcaggctggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacagaattgcccattattgaattatttacatggtataattagggcaagtcttaactggagttcacgaaccccctgaaattgtgcacccatagccacctacacattccttccagagcacgtgtgcttttaccccaagatacaaggaatgtgtaggcagctatggttgtcacagcctaagatttctgcaacaacaggggttgtattgggggaagtttataatgaataggtgttctaccataaagagtaatacatcacctagacactttggcggccttcccagactcagggccagtcagaagtaacatggaggattagtattttcaataaagttactcttgtccccacagtcccc

SEQ ID NO: 81973 - DNA, 374 bp, Homo sapiens
caaaatagttagttggaatgtacgctttaaattttaaaaagaacaaaattgttccaatactctatataactgtaaatgtcttatattttttctaacaagatttcaaagatagtgctgtaacctcacctcacagggagaaaaggagataactccaggaatttcatgcccatgccagagggagctgcagggaccagcaatcactggtaatgtccaggtggacatctggagccacctctccctcttgcttggtccaggccagcatcaacactgaagcaggtaggggttccaggagcattgtgtcctggcagtggcagcacacagtgtctggcagctgacaacgtggaactttacagggtagattgtccagcatgatc

SEQ ID NO: 81974 - DNA, 613 bp, Homo sapiens
ttctatgtgaaaaggttaataatgcaaattttctcttttacaagaaacattttgccaatctgctccatactccctgaaaaaactttccacttataaatggtgttattgtaaagattagagaatgtatcagatcattattgctattgttgttccagaaaatggccctttatacatatctcgtatatgacaccttgtcaatgtatcacacaaatctgtatctttgtttaagaatgtctttgatgagccattaactataagaagtaaagtgttagtcaaaagataagccattgatcttggttaattccatatctgagatgactgtaataatgtcaattattaacatggatgacttggagaaaaaaaaaagccaaaagtgtgaagaatcttgcagctgcataatacggtttatagggattcttgtaataaacagagttatgaagcaatgcatttttatgactgatactgctattttatatttggatgagcattttatttatttatttttttgagacagggtctcactctgtcactcacgctggagtgcagtggcaggatctcagctcactgcaacctctgctcttgggttcaagtgattcttccatctcagcctccc

SEQ ID NO: 81975 - DNA, 412 bp, Homo sapiens
gcagagtgggtgagaaaaaatgactcaggtggctgaaagacctagaagacaagaatcttttacaatttacaagaggtggaatatgcaggaataacttcagtgataataagcaagatatgttaaatagtaaaatctcaaaatgctatagtcagaagcagtattttagataatcacaaggaataaaatgaagtagaaaataagtttacatgaatggggagccattcattcaatcccatctagatgccactcttcctagaaaaatgtagagctcaaccttcccatagcttcagctgttcactgttaactgggaacccccaagtgctgggaaaaacagatccttttcctatcatgtggtaagtaactagtgtcagacattctgtagagcatactggaagaagaaagtctcttttga

SEQ ID NO: 81976 - DNA, 350 bp, Homo sapiens
gaacaaatcagagctaccaagaaagtcactgtttcagcttcagtagtcattatcctcatggaatcaacacagctgtttaccaccctggtcacaggtaagtaaccatttgttctcatatttagtgggacatagaaatgttggcatagattcagatagaagaaactattctgattcttatgttgacttcttaatttcctcctcttgtgcgtagttatctttaatatctataatactgttgtcatctgattattcatgcttatctatctggctcactgagctcttctgagccagatggggcactgggaatattcaatgaggaatttattctcctctatttctctcggacctat

SEQ ID NO: 81977 - DNA, 1533 bp, Homo sapiens
gaacaaatcagagctaccaagaaagtcactgtttcagcttcagtagtcattatcctcatggaatcaacacagctgtttaccaccctggtcacagacttttacttgttggtggatgtgaaactgctgaagtaggcatgtcaaaagcttctagctgtggcctttctgcctggagagttctttcaggatcaccgtattataagcaggttactaatggtggagacggggttactgcagtaccgaagacactgggattattaaggatgttaagtgtcaagttttacagtcgccagggacaagaacaggatggaatttttaagatgagcctttctccagatgggatgctcctggcagccattcacttctcagggaaactgagcatctgggcgattccatctctgaagcaacaaggggaatggggtcaaaatgagcaggtgttggactaatcttaagtagatgaatgaagagtaagtgggaagatggcagttgatgcgatgaatcttgatataatccacagctgttttcacaatttcaccagactccaggctatgatgaccttaatcctgattggaggctctctactgagaagagaaaaaaaatcaaagataaagagtccttttacccactgatagatgtcaattggtgggcagacagtgcagtgactttagctcgatgctctggtgctttaactgtttcatctgtgaaaactttgaagaatttactgggaaaatcctgtgaatggtttgaaccatcacctcaagtcactgctacccatgatgggggatttttaagtttggagtgtgagattaaacttgcccccaaacgatctcgtttggagactagggctggagaagaagatgaaggagaagaggattctgattctgattatgaaatatctgccaaggctcgctactttggttatataaaacagggcctttacttggtgactgaaatggagcgatttgcaccaccacggaaacgcccacgaaccattactaaaaactaccgccttgtgagtttgcgctccacgacaccagaggaactttatcagaggaagattgaaagtgaagagtatgaggaagccttgtccttggctcatacctacggcctggatactgaccttgtatatcagaggcagtggaggaagtcagcggtcaacgttgcttcaattcagaattatttgagtaaaataaagaagcgatcctgggttctccatgagtgtttggaaagagttcctgaaaatgtggatgctgcaaaagaactgcttcagtatggattaaaaggcacagacctggaggctcttttagcaatagggaaaggagcagatgatggcagatttacattacctggtgaaatagacattgacagtatctcctatgaagagctttcaccacctgatgaagagcctgccaagaataaaaaggaaaaggagctcaagaagagacaagaactactgaaattagtgaacttttccaagttgacactggaacaaaaggaactttgccgttgtagacggaagttattaacctacttaga

SEQ ID NO: 81978 - DNA, 1311 bp, Homo sapiens
gaacaaatcagagctaccaagaaagtcactgtttcagcttcagtagtcattatcctcatggaatcaacacagctgtttaccaccctggtcacagacttttacttgttggtggatgtgaaactgctgaagtaggcatgtcaaaagcttctagctgtggcctttctgcctggagagttctttcaggatcaccgtattataagcaggttactaatggtggagacggggttactgcagtaccgaagacactgggattattaaggatgttaagtgtcaagttttacagtcgccagggacaagaacaggatggaatttttaagatgagcctttctccagatgggatgctcctggcagccattcacttctcagggaaactgagcatctgggcgattccatctctgaagcaacaaggggaatggggtcaaaatgagcagccaggctatgatgaccttaatcctgattggaggctctctactgagaagagaaaaaaaatcaaagataaagagtccttttacccactgatagatgtcaattggtgggcagacagtgcagtgactttagctcgatgctctggtgctttaactgtttcatctgtgaaaactttgaagaatttactgggaaaatcctgtgaatggtttgaaccatcacctcaagtcactgctacccatgatgggggatttttaagtttggagtgtgagattaaacttgcccccaaacgatctcgtttggagactagggctggagaagaagatgaaggagaagaggattctgattctgattatgaaatatctgccaaggctcgctactttggttatataaaacagggcctttacttggtgactgaaatggagcgatttgcaccaccacggaaacgcccacgaaccattactaaaaactaccgccttgtgagtttgcgctccacgacaccagaggaactttatcagaggaagattgaaagtgaagagtatgaggaagccttgtccttggctcatacctacggcctggatactgaccttgtatatcagaggcagtggaggaagtcagcggtcaacgttgcttcaattcagaattatttggtatgtttaaatattttggtaatgtggtaaaatgtatattcatgtaatatcttttgtttatagggcttcattttagagtactttacattgctgacttttctataatacagccaatgaagtacaattttctcagctggaaaaatggtctttttgttagattttattgcccctgcaactggactttgatgctgaatacatgtgaacaaatattcacagataaaccagctaactacttggt

SEQ ID NO: 81979 - DNA, 1426 bp, Homo sapiens
gaacaaatcagagctaccaagaaagtcactgtttcagcttcagtagtcattatcctcatggaatcaacacagctgtttaccaccctggtcacagacttttacttgttggtggatgtgaaactgctgaagtaggcatgtcaaaagcttctagctgtggcctttctgcctggagagttctttcaggatcaccgtattataagcaggttactaatggtggagacggggttactgcagtaccgaagacactgggattattaaggatgttaagtgtcaagttttacagtcgccagggacaagaacaggatggaatttttaagatgagcctttctccagatgggatgctcctggcagccattcacttctcagggaaactgagcatctgggcgattccatctctgaagcaacaaggggaatggggtcaaaatgagcagccaggctatgatgaccttaatcctgattggaggctctctactgagaagagaaaaaaaatcaaagataaagagtccttttacccactgatagatgtcaattggtgggcagacagtgcagtgactttagctcgatgctctggtgctttaactgtttcatctgtgaaaactttgaagaatttactgggaaaatcctgtgaatggtttgaaccatcacctcaagtcactgctacccatgatgggggatttttaagtttggagtgtgagattaaacttgcccccaaacgatctcgtttggagactagggctggagaagaagatgaaggagaagaggattctgattctgattatgaaatatctgccaaggctcgctactttggttatataaaacagggcctttacttggtgactgaaatggagcgatttgcaccaccacggaaacgcccacgaaccattactaaaaactaccgccttgtgagtttgcgctccacgacaccagaggaactttatcagaggaagattgaaagtgaagagtatgaggaagccttgtccttggctcatacctacggcctggatactgaccttgtatatcagaggcagtggaggaagtcagcggtcaacgttgcttcaattcagaattatttgagtaaaataaagaagcgatcctgggttctccatgagtgtttggaaagagttcctgaaaatgtggatgctgcaaaagaactgcttcagtatggattaaaaggcacagacctggaggctcttttagcaatagggaaaggagcagatgatggcagatttacattacctggtgaaatagacattgacagtatctcctatgaagagctttcaccacctgatgaagagcctgccaagaataaaaaggaaaaggagctcaagaagagacaagaactactgaaattagtgaacttttccaagttgacactggaacaaaaggaactttgccgttgtagacggaagttattaacctacttaga

SEQ ID NO: 81980 - DNA, 385 bp, Homo sapiens
gacccttcccattttttccccaaaccagaattggctctgtgaattgtgaaagcaagttcctggaatgtacagggctggaactcagggaacagcctagaaacatgcagcagtggggggaattcaaaaaaagtattaaagtactgacttcatacagacaccactgtatatgtttgcatacctacacacacatgcacacacacacagtattagaaatgtctcccagtttgcaagtcctctgcacctcgggagagccaagccattattgccaagccctggtgttcggcacacaaataaccacgtgaccataaaacagcctgcagagcccagtactgggtttgcaacagtctgcagagatggcctaatggcccagccttcaacacttaaa

SEQ ID NO: 81981 - DNA, 465 bp, Homo sapiens
ccaggaccgggagccttcagtcggcctccaccaatgtcagattcacaaggaagcctcagcccacctcacctgcatagcccttctagttttagttttgtattttgtttttcttagaagccctccataaccgtgtgagccacccacccacaaaaggtccaagctgccctgttcttgcctctctccagatgagggtgcgcgagctgtgaccccgccctcgtcactccgaagggattccgctgtcagaaccggaagtctctctcccagagaccctccaccacaggctgagggggtacgtgtgacaataaaagggtcaattcctcaggaagacacaacaatcaaatgtgcagggacgtaaaggagcttcaaagtgcaggaagcaaaatccggcaaaactaaagggagacagatcaaacgcccagccatggcaataatacccctctctcagcaactgacagaactagaccg

SEQ ID NO: 81982 - DNA, 478 bp, Homo sapiens
atgtgcatgtaggatttgtcattccgttaccaaattagggaaaggttttgattggcctaattatgtttgggtttactcattatacttgctgaccacatgactgaatgcattcagaatttacgtctccatggttttactctggttcatccttgctacaggtttagtcatgcagaaaaacaaagggcccgttaggaagaatctattttctccccccccgcaaaacatctcagtgtttgcatatgtgtcatgaagtgaagtaggaaatcaggattttctggatccagcaaggtcagggtggggagcagattttgatccctgcaaccactgaagctgccagccattcctcaccctaaatgaactctgcactccaagaggtccctaaggaccctgagaatccagggggataggaatcagacagccttgtccaaaagctgccacagcaagctgtgtgactttgactaactcccttcccccactg

SEQ ID NO: 81983 - DNA, 974 bp, Homo sapiens
gggaatgccagtccatgaagttgatggttaggctaagatctactgcagatgaagagcatgaacaaagtggcagagacaggaaagagcttgggacttgaaggggtggagaaattcatagaaaactagcatgaagaatgctatttaatgttactaatactgagtgaggcaaagaatggagtaagttggaaagaaaaaataagccaaatcatgcagggctttgagccatagagaaggctggccaactcatccaaaggatttgaccttacataattaaaggagctaatagagtagtctctgtaagactattgtctttgtttctaatgttggacctgaaatccacagggaagggaagggaagggtagaagctgtgtcagttcttgtcattgaccttggtactgtggatgtcttgcagaaagaagccagtgcccttcttgaagctatatgtggccaagaagtcagagaggctgaaggataatccaggggaagatagagtagttataggcccacctgctgcctcacagtaacaacgttaatctgcacatctgtgacatcacagttgagctacaaaattactactgctttacctctgttgaacaaatttcacccaagactccctcctgtggtccacactaaccagaagtttacaaggaaggcagtcctaggaaatgagcagcctaaccaagttgacacattacaaagtcatcatgctctctaagacccttcaacctggatttcctgccagcaactcaatatatcccaaacagaattcttcaaaacctgcttctccttctgggtcaccctattttgttttttaacagtgccactttccttctatgcttaaaattttctaatcttgttaactcccccttttcctttctcatatacctctcatgctaccaccaatctataacagttctatcatttttacctctgcagtgcccaccccaggtggatgagttcaaactcaacaggtg

SEQ ID NO: 81984 - DNA, 759 bp, Homo sapiens
gggaatgccagtccatgaagttgatggttaggctaagatctactgcagatgaagagcatgaacaaagtggcagagacaggaaagagcttgggacttgaaggggtggagaaattcatagaaaactagcatgaagaatgctatttaatgttactaatactgagtgaggcaaagaatggagtaagttggaaagaaaaaataagccaaatcatgcagggctttgagccatagagaaggctggccaactcatccaaaggatttgaccttacataattaaaggagctaatagagtagtctctgtaagactattgtctttgtttctaatgttggacctgaaatccacagggaagggaagggaagggtagaagctgtgtcagttcttgtcattgaccttggtactgtggatgtcttgcagaaagaagccaaagtttacaaggaaggcagtcctaggaaatgagcagcctaaccaagttgacacattacaaagtcatcatgctctctaagacccttcaacctggatttcctgccagcaactcaatatatcccaaacagaattcttcaaaacctgcttctccttctgggtcaccctattttgttttttaacagtgccactttccttctatgcttaaaattttctaatcttgttaactcccccttttcctttctcatatacctctcatgctaccaccaatctataacagttctatcatttttacctctgcagtgcccaccccaggtggatgagttcaaactcaacaggtg

SEQ ID NO: 81985 - DNA, 323 bp, Homo sapiens
tactagccaaatctgggaggatttgagtatgaaaatagtgatgtcagtggatacaacccattggatgaaaagaaatcaatgaattcatacttacatgaatgaatgagtgagtgagtgagttattgaatgaatagggagaaaggaaaatgcttcttacagtagaatgccaactaataaatgaagaaggactgatagaaatagaaaatctcaataggccatcaccacagtggaagctgattcaggcagagtgctctacagatgctaaggctaacgagtgagggtctgtgaggaacaatatgttggtgtcatttcagaatatctcc

SEQ ID NO: 81986 - DNA, 1576 bp, Homo sapiens
gcgaggcagccagcgagggagagagcgagcgggcgagccggagcgaggaagggaaagcgcaagagagagcgcacacgcacacacccgccgcgcgcactcgcgcccggacccgcacggggacagctcggaagtcatcagttccatgggcgagatgctgctgctggcgagatgtctgctgctagtcctcgtctcctcgctgctggtatgctcgggactggcgtgcggaccgggcagggggttcgggaagaggaggcaccccaaaaagctgacccctttagcctacaagcagtttatccccaatgtggccgagaagaccctaggcgccagcggaaggtatgaagggaagatctccagaaactccgagcgatttaaggaactcacccccaattacaaccccgacatcatatttaaggatgaagaaaacaccggagcggacaggctgatgactcagaggtgtaaggacaagttgaacgctttggccatctcggtgatgaaccagtggccaggagtgaaactgcgggtgaccgagggctgggacgaagatggccaccactcagaggagtctctgcactacgagggccgcgcagtggacatcaccacgtctgaccgcgaccgcagcaagtacggcatgctggcccgcctggcggtggaggccggcttcgactgggtgtactacgagtccaaggcacatatccactgctcggtgaaagcagagaactcggtggcggccaaatcgggaggctgcttcccgggctcggccacggtgcacctggagcagggcggcaccaagctggtgaaggacctgagccccggggaccgcgtgctggcggcggacgaccagggccggctgctctacagcgacttcctcactttcctggaccgcgacgacggcgccaagaaggtcttctacgtgatcgagacgcgggagccgcgcgagcgcctgctgctcaccgccgcgcacctgctctttgtggcgccgcacaacgactcggccaccggggagcccgaggcgtcctcgggctcggggccgccttccgggggcgcactggggcctcgggcgctgttcgccagccgcgtgcgcccgggccagcgcgtgtacgtggtggccgagcgtgacggggaccgccggctcctgcccgccgctgtgcacagcgtgaccctaagcgaggaggccgcgggcgcctacgcgccgctcacggcccagggcaccattctcatcaaccgggtgctggcctcgtgctacgcggtcatcgaggagcacagctgggcgcaccgggccttcgcgcccttccgcctggcgcacgcgctcctggctgcactggcgcccgcgcgcacggaccgcggcggggacagcggcggcggggaccgcgggggcggcggcggcagagtagccctaaccgctccaggtgctgccgacgctccgggtgcgggggccaccgcgggcatccactggtactcgcagctgctctaccaaataggcacctggctcctggacagcgaggccctgcacccgctgggcatggcggtcaagtccagctgaagccggggggccgggggaggggcgcgggagggggcc

SEQ ID NO: 81987 - DNA, 471 bp, Homo sapiens
aaacaggttatctgtggagcctcagcctgagtaactttccacaaatgttttactttgtgttttctgctttcctgaggagtatctaagtcatttatagagaaatgtgtttgtgaaaatagcttggattttaatctatatgttatattacaacctctaaatggaacatcttactctaaggggtgcaaagccaattattacatataattaggtaatatctgcattctcaaaaaaccccagtctccttatgacttggtttctagtagaacagggtttagtttcagatgccttcaattctgccgagtagaagccactgtatttgatatagtttgtgtattctaatcatttccccgtatgtatatgcatctatgcttcaccccaaccacactgaatatttggagagaacagtcggcgacttccagctttgtctcccagtgactagcctgtggcatttgtagagttgttggttgttta

SEQ ID NO: 81988 - DNA, 296 bp, Homo sapiens
cgccctcggtgctgttggggtggtgttctgcaggtgggttgaggccgtgtctttcctcactgatcgtctgtctggcggttctctccgtggttagaagtagggcaccgagtctccctgtcactgaagaactgcttttctccttgtcattctgtctattcttgattcagatattttggggtctcttgttaggagcaggaatattttcgtaggaaaaattcctggtagtgaaattgttgggtcacaatacatggcccttgtatgactaggctgaccttgctggagttgatggagtccag

SEQ ID NO: 81989 - DNA, 682 bp, Homo sapiens
tgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatggttacaacacgtggagttttactaacatacatattaaatcaaagtatattcttaaaagtacttgtgaagtaaaatctttcttgtgcattttcaatacttgtaaactggaaatccagaaaaatatttactatgaacaggaaaatctgacatatagccccttttgatatgtttattaataat

SEQ ID NO: 81990 - DNA, 1994 bp, Homo sapiens
ttttttctcttttagaaatggagtaagaatgcttcaaataaaaaacgtaaaacccatcccatcccataaagggcccactcacgtaaacaggaagcttattaaaagaacttttcttggtttcctggcaaaatccagcttttattttggtggcagcatctattaaggaggagactcattttgtgggcaggatgaaaaattaaacattgcaaatccatcaggtacttgctggattagagttagttgactgacttgttggctacagggaacaaggtagttctgaaaccaaggaacaagctgccaaggaacagtccagccctgcccaaaagatgatggtcttctccatccaggcagcacaaatcaactcgaggttccaagagggccagtagacgccagcctaccttactgtaaagtgtctcacatgcatatctaactgttctctcctttcctttacatttaaatcctgttgtattggcttctctgttttccctttcctggaagcgctgtagcgtaattaaaagagtatgagttttggaatttcaaaacttggtttatagtccagcctctgccaaatactgtgacatgttacctgcttgagccatcattttctgatatgtagattgggactaacaattcttccttaatcagctcaagtttcacaaaatatgggtaaacatcacgtgactcaaaatcaactgaggcaaaaattcagatgtcaatggccctttcttgaattattagaacctccatgagctagaaattcttggaatctgaattttaaactcactcccaagtgatttccatacacacagaagtttgagaaccacatcccaccttgtcttgtgtcaggattaaataaaaccatataggtgaaacttatctgtaaattgcatatcaagacatgcttagctgctctcaatagtatcattttccagatagcccaaagcaccaaagtaaggacagcgggccattttcccaagatctttcttccagcttttccctgccatgccaacagcattcttcatcttcaggtaggcagggcaggttcactgggggttggggtagagctcagcactgtgacacaggcagtacttccgtagaatttcatttatgtgactgtacctaccccacagggtgatataaggattaattcctatttggtaatttactgtgtgtaaaatgccttgagccccttggaggaaagtgctatataaatgtaaaataattattataataataataacctcgactatttaactgatcagtgaattagccagaagatttaggctgccaagggacaaggctgaaaccattataagtagaaacactttacatcatcatatctcaaactgttatcacgaaaaagggaaacaaagggtgaaaattaagataaatccatgttctcaactgatttaaatgacagaggatcactagtaatgattcatgaaagccaggaaatgcaaaaatgacagctgcattgtaattctaactcagccacatgtcctgaggttttgtacactttggtcttttatttgtagggaaaatatctcatcagtgcaacatctaaaatttagcattatgaaggcacttgactatgcttttgcttagttgaaatacgttcataatgtatcccctatttgtaggtaatgatttttctacctaaaaagcattgacattattctatgaagttccaggtaaattttgaatcggttgcttacaatctgcctccccacatacacaccctaagaatacactctaacaaaacaatggtgtatttctagatctaaatttaggaaaccaaaatatatagaagataccttttcttcccaggaagaaaatgctttggtatataaactcacatgagctcaaccgtcttcagctcttacattatttgttttatttatttattagattcatgaagattcttctaccaaaagctcaaggggctgaacccagaactttcatatattgaatgtgaatcacttcttaaaccacag

SEQ ID NO: 81991 - DNA, 887 bp, Homo sapiens
ttgtagtagcccaggtgagaaatgaggctggactggaccaggtagtccaggagaaataagtggatagatctaaaatacatcaaaaaataaaatcaagaggacttaggcatgaccgcaacagagaaacctctgcacttgcacccacactggctgccgcacagtgtggactgggcaaccctgagcacaactgacgatctgggccgcttgaggagcagctggggaaatgtgagcacagcccccagggagaggggcggggaacaggaccctcctctgccatctggaagagagaggggtgtagggccagtagtggaagccacggtgggtggatttttacctccatatgtggtggggatttctaacatcagaagggtccaaatgtgtcatggactgccccagggaattcgggttctcatcactgaagattttcaggcccaggctggacacaacccggtgggggtggtatgactgaggccacacctcagatgggagtcaggaggtgactccaaaggcacgctgactgggtgacgctggctgtcttcttaggaaacctggttctggtcggggacgccaagggcccaggaggtggtgatgagtggggtgcgctgctcaggcacagagctggccctgcagcagtgccagaggcacgggccggtgcactgctcccacggtggcgggcgcttcctggctggagtctcctgcatggacacttctgaaatcttacgcaggaggtttttacttcctctgaattccccacgcattgttcttcttttaaaacactcagcactttccatcttggagaagagttgcagacctgtcctatctctgctgagctctccgagggcaagcattgcctgcttcctgtctgcacacccacagtccctaaccct

SEQ ID NO: 81992 - DNA, 394 bp, Homo sapiens
ggctggggggccgcgggcgggaggcggataaaaaggccccagggcgcccggggagggagcccgttagcgctgctccgccgcggcgcccgcccagccccggactgtccgcgctccatctggtatcttggcctcagctgtccttgaagtcaccatggcgtggtccccaccagccaccctctttctgttcctgctgctgctaggccagccccctcccagcaggccacagtcactgggcaccactaagctccggctggtgggcccagagagcaagccagaggagggccgcctggaggtgctgcaccagggccagtggggcaccgtgtgtgatgacaactttgctatccagcagcaccaccaggacagcagcaccaccaggacagcagcaccaccagga

SEQ ID NO: 81993 - DNA, 3548 bp, Homo sapiens
ggctggggggccgcgggcgggaggcggataaaaaggccccagggcgcccggggagggagcccgttagcgctgctccgccgcggcgcccgcccagccccggactgtccgcgctccatctggtatcttggcctcagctgtccttgaagtcaccatggcgtggtccccaccagccaccctctttctgttcctgctgctgctaggccagccccctcccagcaggccacagtcactgggcaccactaagctccggctggtgggcccagagagcaagccagaggagggccgcctggaggtgctgcaccagggccagtggggcaccgtgtgtgatgacaactttgctatccaggaggccacagtggcttgccgccagctgggcttcgaagctgccttgacctgggcccacagtgccaagtacggccaaggggagggacccatctggctggacaatgtgcgctgtgtgggcacagagagctccttggaccagtgcgggtctaatggctggggagtcagtgactgcagtcactcagaagacgtaggggtgatatgccacccccggcgccatcgtggctacctttctgaaactgtctccaatgcccttgggccccagggccggcggctggaggaggtgcggctcaagcccatccttgccagtgccaagcagcatagcccagtgaccgagggagccgtggaggtgaagtatgagggccactggcggcaggtgtgtgaccagggctggaccatgaacaacagcagggtggtgtgcgggatgctgggcttccccagcgaggtgcctgtcgacagccactactacaggaaagtctgggatctgaagatgagggaccctaagtctaggctgaagagcctgacgaataagaactccttctggatccaccaggtcacctgcctggggacagagccccacatggccaactgccaggtgcaggtggctccagcccggggcaagctgcggccagcctgcccaggtggcatgcatgctgtggtcagctgtgtggcagggcctcacttccgcccaccgaagacaaagccacaacgcaaagggtcctgggcagaggagccgagggtgcgcctgcgctccggggcccaggtgggcgagggccgggtggaagtgctcatgaaccgccagtggggcacggtctgtgaccacaggtggaacctcatctctgccagtgtcgtgtgtcgtcagctgggctttggctctgctcgggaggccctctttggggcccggctgggccaagggctagggcccatccacctgagtgaggtgcgctgcaggggatatgagcggaccctcagcgactgccctgccctggaagggtcccagaatggttgccaacatgagaatgctgctgctgtcaggtgcaatgtccctaacatgggctttcagaatcaggtgcgcttggctggtgggcgtatccctgaggaggggctattggaggtgcaggtggaggtgaacggggtcccacgctgggggagcgtgtgcagtgaaaactgggggctcaccgaagccatggtggcctgccgacagctcggcctgggttttgccatccatgcctacaaggaaacctggttctggtcggggacgccaagggcccaggaggtggtgatgagtggggtgcgctgctcaggcacagagctggccctgcagcagtgccagaggcacgggccggtgcactgctcccacggtggcgggcgcttcctggctggagtctcctgcatggacagtgcaccagacctggtgatgaacgcccagctagtgcaggagacggcctacttggaggaccgcccgctcagccagctgtattgtgcccacgaggagaactgcctctccaagtctgcggatcacatggactggccctacggataccgccgcctattgcgcttctccacacagatctacaatctgggccggactgactttcgtccaaagactggacgcgatagctgggtttggcaccagtgccacaggcattaccacagcattgaggtcttcacccactacgacctcctcactctcaatggctccaaggtggctgaggggcacaaggccagcttctgtctggaggacacaaactgccccacaggactgcagcggcgctacgcatgtgccaactttggagaacagggagtgactgtaggctgctgggacacctaccggcatgacattgattgccagtgggtggatatcacagatgtgggccccgggaattatatcttccaggtgattgtgaacccccactatgaagtggcagagtcagatttctccaacaatatgctgcagtgccgctgcaagtatgatgggcaccgggtctggctgcacaactgccacacagggaattcatacccagccaatgcagaactctccctggagcaggaacagcgtctcaggaacaacctcatctgaagctgtcactgcacactcctagctgctgccgatacaccagatacctcagcttattggagccatgcccttcacagagtcccaactcagaggaaaagggccagtgccaaggggcaccaagaacctgctcaggaagccttttgatggcaagatcaccaatccagatggtattgctccctcaggatggctctgggcctgcccctaagggcctgtggcctatggaatatgtcctccaggctttgctcagctgagctcctcttctgtaaggaaacccagtcatccctgaatcttgccacagagatccgggattcaggagctctcagtttcttagggatggactatggcccagtcccccatctaagtggtgctttgcaaatgtcttggaggagtataggacagaggaccaaaatacacagcaggtagtgttagctctctgctaggagctcaaagcaacacaacttgtatcaaaatcacaactggcagagaagctggtggatccaatcctttcttcatctgttgttatttagaactcacctctcacactctgttctttagtgtccttacctttatcttaccacacacatgggtgtttctattatccttggaagcacagacctcgggcatccccttattgcctgatgggccaacaccaacagttacggagtgcttgagaaggggcaagtttcacagaaatggccagatagggccttcctacagagcagcaagagtaggccaagcagaaagactgctgaggtaacacggaccccagcccctgtcagggcctctgccaaggaaataatatggaccatttacctggcaggcagtctgctctctctcaggatcaccacgcatctcaggattggtctaaacttcaagtctcaaccaagtgtctgaagtgaactttgcattgaataaatttttgccatggaaagaacatcaaacaagccactcatctctacagagataagaaaacaagtttggcagagcaagagacagaagaccgtggagaaatcagaagggggaacagtcagtttagttaaggatggaacctgggaaaggccaccattcctgcttgatggggctctgatttgctcttgctcaagtggaataaaaccccatggtcttcttg

SEQ ID NO: 81994 - DNA, 3658 bp, Homo sapiens
ggctggggggccgcgggcgggaggcggataaaaaggccccagggcgcccggggagggagcccgttagcgctgctccgccgcggcgcccgcccagccccggactgtccgcgctccatctggtatcttggcctcagctgtccttgaagtcaccatggcgtggtccccaccagccaccctctttctgttcctgctgctgctaggccagccccctcccagcaggccacagtcactgggcaccactaagctccggctggtgggcccagagagcaagccagaggagggccgcctggaggtgctgcaccagggccagtggggcaccgtgtgtgatgacaactttgctatccaggaggccacagtggcttgccgccagctgggcttcgaagctgccttgacctgggcccacagtgccaagtacggccaaggggagggacccatctggctggacaatgtgcgctgtgtgggcacagagagctccttggaccagtgcgggtctaatggctggggagtcagtgactgcagtcactcagaagacgtaggggtgatatgccacccccggcgccatcgtggctacctttctgaaactgtctccaatgcccttgggccccagggccggcggctggaggaggtgcggctcaagcccatccttgccagtgccaagcagcatagcccagtgaccgagggagccgtggaggtgaagtatgagggccactggcggcaggtgtgtgaccagggctggaccatgaacaacagcagggtggtgtgcgggatgctgggcttccccagcgaggtgcctgtcgacagccactactacaggaaagtctgggatctgaagatgagggaccctaagtctaggctgaagagcctgacgaataagaactccttctggatccaccaggtcacctgcctggggacagagccccacatggccaactgccaggtgcaggtggctccagcccggggcaagctgcggccagcctgcccaggtggcatgcatgctgtggtcagctgtgtggcagggcctcacttccgcccaccgaagacaaagccacaacgcaaagggtcctgggcagaggagccgagggtgcgcctgcgctccggggcccaggtgggcgagggccgggtggaagtgctcatgaaccgccagtggggcacggtctgtgaccacaggtggaacctcatctctgccagtgtcgtgtgtcgtcagctgggctttggctctgctcgggaggccctctttggggcccggctgggccaagggctagggcccatccacctgagtgaggtgcgctgcaggggatatgagcggaccctcagcgactgccctgccctggaagggtcccagaatggttgccaacatgagaatgctgctgctgtcaggtgcaatgtccctaacatgggctttcagaatcaggtgcgcttggctggtgggcgtatccctgaggaggggctattggaggtgcaggtggaggtgaacggggtcccacgctgggggagcgtgtgcagtgaaaactgggggctcaccgaagccatggtggcctgccgacagctcggcctgggttttgccatccatgcctacaaggaaacctggttctggtcggggacgccaagggcccaggaggtggtgatgagtggggtgcgctgctcaggcacagagctggccctgcagcagtgccagaggcacgggccggtgcactgctcccacggtggcgggcgcttcctggctggagtctcctgcatggacagtgcaccagacctggtgatgaacgcccagctagtgcaggagacggcctacttggaggaccgcccgctcagccagctgtattgtgcccacgaggagaactgcctctccaagtctgcggatcacatggactggccctacggataccgccgcctattgcgcttctccacacagatctacaatctgggccggactgactttcgtccaaagactggacgcgatagctgggtttggcaccagtgccacaggcattaccacagcattgaggtcttcacccactacgacctcctcactctcaatggctccaaggtggctgaggggcacaaggccagcttctgtctggaggacacaaactgccccacaggactgcagcggcgctacgcatgtgccaactttggagaacagggagtgactgtaggctgctgggacacctaccggcatgacattgattgccagtgggtggatatcacagatgtgggccccgggaattatatcttccaggtgattgtgaacccccactatgaagtggcagagtcagatttctccaacaatatgctgcagtgccgctgcaagtatgatgggcaccgggtctggctgcacaactgccacacagggaattcatacccagccaatgcagaactctccctggagcaggaacagcgtctcaggaacaacctcatctgaagctgtcactgcacactcctagctgctgccgatacaccagatacctcagcttattggagccatgcccttcacagagtcccaactcagaggaaaagggccagtgccaaggggcaccaagaacctgctcaggaagccttttgatggcaagatcaccaatccagatggtattgctccctcaggatggctctgggcctgcccctaagggcctgtggcctatggaatatgtcctccaggctttgctcagctgagctcctcttctgtaaggaaacccagtcatccctgaatcttgccacagagatccgggattcaggagctctcagtttcttagggatggactatggcccagtcccccatctaagtggtgctttgcaaatgtcttggaggagtataggacagaggaccaaaatacacagcaggtagtgttagctctctgctaggagctcaaagcaacacaacttgtatcaaaatcacaactggcagagaagctggtggatccaatcctttcttcatctgttgttatttagaactcacctctcacactctgttctttagtgtccttacctttatcttaccacacacatgggtgtttctattatccttggaagcacagacctcgggcatccccttattgcctgatgggccaacaccaacagttacggagtgcttgagaaggggcaagtttcacagaaatggccagatagggccttcctacagagcagcaagagtaggccaagcagaaagactgctgaggtaacacggaccccagcccctgtcagggcctctgccaaggaaataatatggaccatttacctggcaggcagtctgctctctctcaggatcaccacgcatctcaggattggtctaaacttcaagtctcaaccaagtgtctgaagtgaactttgcattgaataaatttttgccatggaaagaacatcaaacaagccactcatctctacagagataagaaaacaagtttggcagagcaagagacagaagaccgtggagaaatcagaagggggaacagtcagtttagttaaggatggaacctgggaaaggccaccattcctgcttgatggggctctgatttgctcttgctcaagtggaataaaaccccatggtcttcttgacatgattcttgatcttttctccactgagacacacttaagtgatgatccttacaggactgacaccctaatgccaataaaagttgctcattatggactgctacaaaaacca

SEQ ID NO: 81995 - DNA, 641 bp, Homo sapiens
aaacactgcatgttctcactcataggtgggaattgaacaatgagaacacttggacacaggaaggggaacatcacacaccagggcctgtcatggggtggggggaggggggagggatagcattaggagatatacctaatgtaaatgacgagttaatgggtgcagcacaccaacatggcacttgtatacatatgtaacaaacctgcacgttgtgcccatgtaccctagaatttaaggtataattaaaaaaaaaaaaaagatgttgcctttagtttctatagggaaccaaacgtcccacgactctaacttccttggctattgttttaagctgctattaccctcttgcttatcaagttgttcatttgcttctcagggccagctaggtgcctggaacttctcttgaaggaactcaagattttcctttatttccatgctgggggcgggggaggccataggcctcaaggggttcctgctccatctgaggtccatgttcaaaagaattgaaagtaggtctcaaaaatatatttctacacccacattcacagctgcattattcacaataactgaaacatggaaacaacccaagtgtacgatgatgaatgaatggatgttagatgttgtgtatacatacaatattgagacat

SEQ ID NO: 81996 - DNA, 481 bp, Homo sapiens
tctgggctcgtgccgttttgatataaatcattcaccagaaaccattaaggaagcctggtgatcatggagtaggaaggtttttgacaagaacgtgaagaattccagatgaacacagcaaaaccaaagctggtgaaattctgtgcaaactagcatgaggcagtgtgctggggagaatagcattctagccaccagtacaatcaatctcatgaccaatggggtaagttgtaacctttccagaaaggtaccgaggcacagagaggttgggtacccaactaagcacagagaaagtgaagaagttgttggacttaagcaataaaagtgatagaaaagataccatgtagtaaatgtgtagttcttcctcacttcaagtaatgtgttccattttaatcatttcatccaaaaagacaaaagagcccccaaaaaaggtctagggaagagcaatggaaaacgttaagtgtacctgcaatcaaataaaggcagg

SEQ ID NO: 81997 - DNA, 964 bp, Homo sapiens
agcggacttccttttaatcttttaggtctcagctcaaacgtcacctcctcaaaatggcttgctaggactgtccctgtcatcctttatcatttacaaaatcctttatgactcatttattgcatccacttctttacttccaacatcaccttcccatcatttattgtgtcacctttatttcctttatagagcttacaataatttgtattaatttggattaaatactggaatgtgggcatgtttgttatttactgtctgtctcccccactgactgtaatttgccaagagcagggaattcagagtcttattcacagctgtatcctcagaatccatcatgggcctgagacttagtaggtgctcaataaacattagtagaatgaatgaatactcattagtttggatggtacaattgtgactatggtactccaagagaagactgatatggtagtcccctattatctgccgttttgctttctgcggtttcaattacttgcagtctgaaaatattaaatagaaatttccagaagtaaacaactcataagttttaatttgctcacctattctgagtagcttgatgaaatctcccacccacccgggacgtgaatcatctctttgtccagtattttcacactgtaccggatacctgcctattagtcactttagtagctgtcttggttatcagatcgactgccgcgctatcctagtgtgcgggcttgaaaaacctttattttgcttcttaatggttccaaagcacagagtagcgatactggcaagtcagatatgccacagagaaagctgtaaaggtgcttccttaaaggtgaagaacaccaaaagttctcagcttaataccgaaagaaaaaagacttataggctgaggttgctaatgtctattgtaagaaccaatcttttagtggtgaaattatgaagaagcaaagagagatttgtgcagggtatatataaggtttgg

SEQ ID NO: 81998 - DNA, 627 bp, Homo sapiens
gtgacaaagagcaacaaagagccacaaagagcaggctgcgggcgggaccatcgggaccatcacagaggcatcagccctgccccggagtggctgcagatgcatccctgagggagggggctggggtgcaggtgctccctcccgaacagggggtttgttagcttcatctgcaaggccctgaagccaggctcttttcaaatcgtcatcatgtgtgcaccgtacactcccttctgactctgggggcctgggcgcctgcttagtgcagccttaaattttttacgtaccagtaaaaatactgcatgtaagattctgttcctaggaggataaagggatggccagagctggctaagcggagtctcgacggactaaaggtatgggaaaatgaagacgtggacctaccacgttctcttctacctggaacttaggatttgtaaattgcatttagatgtcatttgtcacattggtaggctgtgacttaatacactcacaaagaggatttttccaagtatttaaactgtgtagatgctgcaaaaaatcagactgaggcaaagccctgcagccaaccccagcagcaagaggtgaggaccccctgtctgtcctgggccccactcaggcactatcctcatctct

SEQ ID NO: 81999 - DNA, 208 bp, Homo sapiens
atttttaaatcccaggggccaaagttaccccctcattcttccgaattgaaatgtgcaaccttaaagaaatatctatgcttctctcactgtgcctttccaaacggattgaacattttaagactagttcttgaaaatagctaatacagaataattatttgttttgtacagaataaatattatgcattttaaatgcttaagaaaagacatc

SEQ ID NO: 82000 - DNA, 771 bp, Homo sapiens
tttcattaggtcttctattatctcctctgtgccctcactctcccttcccttcttaaatccccatccttctaccttggcctcacctactgaaatctcactccaccttccagttcaaaccaaattccccaccttctgggaatcccttcctcagtagctgcagactacactggcctgtcttttcccagacttctcattccttcatgttagcaccacaatgcttagcaactagtggctttttcaataagaaagatgtagtcttatttatctctttgcacaactcccttctctattgtgttttccacatttacataccactttggggcagaaattggcccagtggccaaatctggcccactttctttttgtatggtctaaagctaagaatgtttttgtattttaaatagtcaaaaaaagatcaaaagaagaaaaatgtttcatgaagtgtaaaaattacctaaaatttaaattttggcatctacaaataaagttttattggaacgtagccacactcatttgtgaagcaggttcactgtgcactggttaccaacttgtctgagtctggtaaggcagaagatccttaaacataacaaattacatgaaacaaatttattatttacagataaacagcaagggataacagaagtgtaggattgattgtgagcttctccccccaaactcagaaaaactgccaggtaaatgaggtctcatctgcatgtgccccacttgcattgctactgagggaccctgaaaagcagacaaccctgggtgtta

SEQ ID NO: 82001 - DNA, 610 bp, Homo sapiens
ctgctgtgtagaagtttcaaccagggatatgcatcaagttagacacaaatacagccacatgtaccttacctaccatagactgagctcaaatctccaggggcagaccctgggcaaggcatgtttctaaaatgtatcccagggaagtgtgatgtgcagatctggttaaaaggctctcctgctgctcttacacaaagaagtgccaagagagaaaagtcagaacagaaaaaccgagcagtgggtccatcctctgtaaacttggcacctccaccccttgtagcacttgaagtcactgagaagacagagacatgccttaaacactggctccatcacattgaagctggttggtcttgggcatgttacttaacctttttgtgcctcagtttcctcatctagtaaataggaggtaatgagatctactttgcagagctgtattgaggactgaatgagattaagacatgtggaatgcttagagcagtgcctgccatgtcatgagactcgacaaatactgctttggtatcaacagcgaggagaatcaccctcatcagactgtgcaacagcatactctccagaactgcacatatccaagggagagccccagatgcggccgcat

SEQ ID NO: 82002 - DNA, 594 bp, Homo sapiens
ccaagtcatttaaagatagtgctcttatatgactctaaactattacctcttccttccttgatataaaggagctttcaccagttgttgacatggttagggattgtttaagtgtaaggacagagttttcagggaaaatcgggattggtagtccatttctaccctcaaaagcccatgcctacctaacagtgtgatatggacagcttagtacatcaacactaattcccagaaatagtgaaacctcaccatatgattattctcaaagcttatgccataaaactgatttgaaattaagtcatatttataacaagctcttttgcccttggtatttctgttgctgacccacattgtataaataccaagataaatactaccatttattgagtcctgctttttatcagttagtattatagcaaatttcaattgtagtttaatcactcaagttaaaaatatatatattgggcacctacttttacaagatactggcatacaataatggattcaatgttgaccagtataagtttcctgtcttcaaagagcttgtagtcaaggagagaagacagatatacaaataatgataatgtataacacagtgtg

SEQ ID NO: 82003 - DNA, 262 bp, Homo sapiens
ccagaagcttcttgccttctctgtgctctcagtggttcccttccctgaagtgcctcccttctcattaattatagcctgtgtctgaacattgtgagctataagaaccctcatattaatggttaagggactgttggaaatgatgtgattttattaaaaatggggtctttgtggaggagtcaggaatggtcaaaatgagcttcaggtatggggcttgctctgtgctcctgataccaagggtctggcaagcacaaaggaaggtgag

SEQ ID NO: 82004 - DNA, 424 bp, Homo sapiens
gcgtggcacaagtaggcattcaatgatatggttgctattatgtcattaatagagataatacatggaagtagaatttctggatttagcataaaagtaagatctgccagagggcacatgtaataaagtgatatatcttgtccaaataacatcttattttttctggaaaatttttgcttgtttgattttgtttattaaagcttaaatatactaaaaagaacctggatttgaactgaacaaaattgccaatgatattcaatggcttttgacctataaaaacaactatttggtatggtttaacccaacacaactcaactctaacatacagacaagaacccttaggaaaactactgtaaaatagggaatatgaaacaaggtatatgatttccaccacacataacaaatagtattttttagaagtttgggg

SEQ ID NO: 82005 - DNA, 369 bp, Homo sapiens
gaatgtataacaatagactgttgttttagaaggcatatgaaaattttttgaaattgcaaagctgcagtggctcacacccataatctcagcactttgggaggccagggcaggagaatcagttgagcccagtgtttgagaatcagcctaggcaatatagtgagaccccgtctctacaaaaatttttttagacagggctgattgtacatgcctgtagtcccagctatttgggagacgaggtgaggaggatcacttgagcccaggaggttgaggttgcagtgagcagtgtttgggacagaaactctgtgtcaaaaaaaaaaaattttttttttttgaaagacagcacaggtaaattgtttaaaataggcatct

SEQ ID NO: 82006 - DNA, 372 bp, Homo sapiens
acatttgagaataagaaattactctcaagaacttcagaaatctgcaacataattttataaatatataaatacatgtatgtatgtcaaaacactacatatacactttcagaaagaataaactttctcaagtcattttaaagttacctaacgttcttcttgaataactaatacagtgggtcaaatattataaaataggcaaacaccaaaatggtattaaatattgaactcctgaccttttcgacacttacctagtaaagtattcttaggcatcatcataacttttcctcacctttattcgaatagaggaataaatgtcttcagttgtctctccattacccctaagttattagtttgtctagtttatatataaag

SEQ ID NO: 82007 - DNA, 602 bp, Homo sapiens
cgtctccttccaaacagaagggagaatgagttgaagtgaaaacaatgcctttacctgctgcacactcgcgactctcatataggagtccaagacgatcaacagaggcacatggatatttttgccttgaaataacttggaggctggaaaacaagtgggtggggaaaagaagcaaagtcacaatccacagcaccccctctcctttttagtctgaaacggggagaaaagtcaaaaaggtgaagaccttcctgaaattctcagctgctttctgccctaaggaaaggatatgggagtttgcggctccttaagagtccgggtttgagcagggtcaaggggaggaggacaaaatttgcaaatgtaaggagggggagaaagtttgcaaaaataaaagcacagtttattttcaagtgattaccgcgctcggagtacgtgaacaccagcagatcctccaggatttggaccagcgtttctatctgttttccttcctggacattgttcagcctgactatcaacttcttcagagtttcctcgtcctcttcgcacccctgacagctgccactagccatggtggcacctgcttccaacccgccgccctcccagcatga

SEQ ID NO: 82008 - DNA, 589 bp, Homo sapiens
gagtaaatgaggggtctacagcacaaacccgggagcactggcattttttgagcttacagtgagctgggggtggggaaagcggcagaggggagtgtcctgagaaggtcccagaaatctccacattgattactccaggtctaaatactagcttgaaaggggaattagactttatgtattgccaaaagctattggtattctcttgctaagcatgtcaccaactgctgaatgttcagagcctactatgaacttgaaagaaaacagagcattgacccctgcattgatccctctctctccaaatatattcttacccacattgctttcctctcatggatagagatgtattcctacaacacccagactttgaacatgttttgcatccttccctctcctcgcctctccctgtctaatatatctctatcaagctttgcgtttgctaggaggcacaccattcatttcagtgatctctgctattgggtcctgcatgaaaaagaagctgagcaacatgatccctttgacccactgctggagcaacaaatttatcagaaatataggcatgagaaatgaaagggaagtaaaacaattccagctt

SEQ ID NO: 82009 - DNA, 974 bp, Homo sapiens
gggaccccatctctgacttgggtgcatcccaaatttagaaggaaacagaaggcatggctgtcagtgaatttttcctcatcactccccatagctctctccccaaaccagggaaggggtcattcttgttcttctctgggaccccacacccacacacatctgggccccctcactctggggatttgattcccggacctgggatcctgtcgtaggctgggaccctgttccaggagttcagcagtcctcatttacaacaacagtgaaaatgctccagtaaggcctggtgccttgtgagctgctcagctgggttggccaggcctgtccccatagggtcttaataaggtgccccattttctaaggttagaagctaaaggggccttttaaaccatcttatctaaccctcttgcttacagatgagcaaactgaggccagaaagggaaaatgactggttcagtgccacagttcatggccaaaaaggaacccacatgtcctggcccttcagggaaggaggcaagaacaggaagctggatccattgacccagacatcctctatcccctttctgtcctctcctacagtgagaggcccagaaattgccccagggcagggctctggggcagaaccaggttttgtgaatcctaagcatatacaatttgggggcatctctttagaaagaatacaaaattagcttcatgataaatctgcatctggcagtcagagtgggcatgatcatgaggtcttagctgcaccagctcaactgtagatggagggcggcccctcaacacacggcacaggaagtggggaagggacagcttcaggagtagttcaggaggctcaaatggtgggtacttgcaaaggccttgcccaatgaccccccgctccagggggagaaggggtaagacccaccccacataaagctcaacaccccttccctcactctgccctaacccacagccccatgcccaggatggtggggcat

SEQ ID NO: 82010 - DNA, 144 bp, Homo sapiens
ctgctacggttcaggttagatgagctgctcccgttggtggtttttatctcttagctacacagctgcctgtagcactctcgtctttcagaatgagttgccaactttccattctggccgtcagaattaaaacaaagaatcatcctc

SEQ ID NO: 82011 - DNA, 564 bp, Homo sapiens
gttggtgaagttagttttgactacttcagatggcattcattgggtttctccattgtgaagttactattttgttcctttattaattggtaatttgtggagagatactttgagattacgcagataatcctgttcctcaccaaattttcacacactggttttagcatccattggtgtttttctaacaccattatttcttctacatttattagttgccattctactgtgagagcttttccttcttccccaacttatttgttcattcatcatttaggtatggactctttgattctcattttattttatgactattatcatcaatctcttgtttagattcccaaaatgtattcagtttggccaatagaggactcttcaagctggcttctttatctttgacatctcattttttgaggacttccatattttgtcttaagaaggtgtttcagactcatattttccctgcctgaattttagagtcagccattttaccaaggaaccctagtttcttttctttggctaggagaacagtatttagaaacccagctctgggtgctagattttcttatg

SEQ ID NO: 82012 - DNA, 447 bp, Homo sapiens
tctggagcaagcggggaagaaggagaaagagcaatcatgcagctggggacaaatctttggtggctttatcagattctcagtcaatcaatgggggttggctagaaccggggtacgcagggggcatggaagagagagaatagtgaaagaaagctccaatattttggcccgagcaactggaaggaccaaattgcctcacaggtgggcagaagcccaatgttggacacatcgcatcacgtgcacacctatcagatatccaagtggagataccaagtgtggagctgaagttgcagaccttggcttcaggggagacacatatttgtgggttaaggcaggcagccttcaagatcccacctcccgcgtccacgcccctgtgtaatcccctctgacactgtgtcagagctggtctgtgtgaccaacagaataagtttcagccattgcacattctgc

SEQ ID NO: 82013 - DNA, 342 bp, Homo sapiens
acagaccaaaatgaaaaatattttcatcatggccgtccaggaagtagaaaatcagctaagtgctaagtggaacattcatttcctctttctagtattttggttaacggaaatacatccccccaaaatgcccccaaaatatagttagagaaatttggtttagaggatggtttctagagtcaggtcatgtgggtcaaaattctggctcccctacttaggacatatccctgtgtaattttgggcaaattacttaatttccttccttgttttagttccctatgctgtaaaatggggataaatggggatgatgataatatctcatattatcatcacatttgaggattc

SEQ ID NO: 82014 - DNA, 439 bp, Homo sapiens
agcatagtgaatcactggctaatctggccttcgaggtagtgaaaggaaaaaagggaaatgaagctgactgtggctgaatgtagtaggtcttgaaggccaaatggggcgatctgatttttattctagaagcagaggagaaactaaagatttttttaggagactatattcaagcttgtatcattagttcatcagacgtttatggaccacccaccgtccgtgcactcacggggcttgcagtctatctggctgaatcactttggcagccagtgtgaggagggcacagaaaggagaccaggtgagaaagccagcctgaccaaagaagatgtggcaactgatgggattggaggaggcggacaatgtcctccagacagctggactggctctctatatatttatttatctcttctacacctccagcccccacctccacactcactaa

SEQ ID NO: 82015 - DNA, 156 bp, Homo sapiens
ggcacaatttttcattgatcttcaatagctcctctttcttattacacatatcttactatacttatatgtctaattgaaaagactcaaaagaccaatagtgataagaagaactgggattgtgtgtgtgtgagagagagagagaaagagagagcaagc

SEQ ID NO: 82016 - DNA, 370 bp, Homo sapiens
cctgagcaacatagggagaccccatctctgcaaaaaattaaaaagttagacaggcttggtggctcatgtggtcccggctattcaggagactgaagtgggaagattacttgagccagggaggtcgatgtctcaagtcagctatgatggctacagtaagccatgatcgcaccactgcattccagactaggcaacagagtgagaccccctcttgcgggagggaaaaaaagaatagaataaaagttgaaaactgcacatgaatataattttgtttgtggattcagagactcactcatcacttaaaactctaggtttaaaattgtgtgggaatagaaactatatatttatgagttttcactctgtctcatacttt

SEQ ID NO: 82017 - DNA, 403 bp, Homo sapiens
gtgaaccaccacgcctggcccgttctcccattcttaggctgagtttggtctgtttttcaaatgagttgtcaactatgaaaagcctgtgtatgccaggagacatttattaagcacctgctatctgccagacgttgtgccaccactttaggtacatcgttgcctgtaaccctaaacgctatgaagtgtaggtactattatcatcattcctgttatacagataaggaaacagtcacatgggcttccagaggacaggcaaactcccctcagagagggcagctggccaagtgatggcaaatggcgtgagcccaccttggggtgaatccacagtagctgttaactcactagacccccgcattctaattgaaatgtgtctgtcccagctgggcgtggtggtgcacctgta

SEQ ID NO: 82018 - DNA, 439 bp, Homo sapiens
ttaagacaatttgccttttaggaccatgtaagtttagacatcgtgctatgtcatgttctggactagaacgctccactagaaagacaggcgttgaccctaagggcactaccctacagtagggtggccatttgtcctgccttgccttggaccatctcagttttagcactaaaagtcccatggtctcggaattccctcagtctcagggaagctgggatggttggtcaccctcacctacactcagccggagccatagaagtgtggctgtgggtagctggccctgttctcatccagacagagaggaccatctccaaatatgattctgaaagcagcctcagagctaggaatgccctgttgaggcaatggctgcctcactgcctattttccagctcacactagcaatttccttacttcccagaggctgcaccccacaaggatttcg

SEQ ID NO: 82019 - DNA, 433 bp, Homo sapiens
cgcaaagcagcacacatgggtctaggattgaggagaatggagctttgggagaataaataaatcctgagcgttgagggcccagtttgggtcactgactgtagttttaatcatactcatctcagtggttctataattttctttagcaggacttggcaatacagatttagacaaagagcaggcttgagcctagtttggagttttgctaaggttgagcctagtttggagttttgctaagaaagtataatggatgagcagaagagttttctcaacttgtttattaaaaaaaaaaaagaataatgggtagagtggctttctttatttgcttagaaatagttcacctttctgcccaagtccaatatcttccatttttctcttgaatttgacatcataaaattatatttttaatagatccccttaagcctaatggcccaaa

SEQ ID NO: 82020 - DNA, 291 bp, Homo sapiens
ttaaaatactccatatatttgagaagcaattgaaaatgcatccatgtatgttatttgagcgttactagaaatttatttatacaaatccatattaatgtgctaataagtgacaaatatatatatagtcatgcactgaataatgatgttttggtcaatgatgaactgcacatacaatggtggccccataagattaaaatagaaccaaaatttcctatggcctagtgatgctgtagccatcataatgtggtagtgcaacccattaccttttctatgtttaaatatacaaatact

SEQ ID NO: 82021 - DNA, 838 bp, Homo sapiens
ggcaagagaatcgcttgaacctgggaggcggaggttgcagtgagccgagattgtgccattgcactccaacctgggcaacaagagcgaaactccgtctcaaaaaaaaaataaaaaaagaaagtgaaccatgaggagggcctaggagaagccaaaggaactaaggaactacaccatttgaaagggaggtggaggagctggccaagaaggcttgaagagcaaccagaggggcaggagaaagccaggagtactcttatgaagaggagggaatgccgaccagctgagcctagtgctgctgacttggtctgacacaaaagatgtgtcctttggtctagtcatgtggaggtcatcagaggaggtcatcagtaacctcggtgagagatgctgtattctcagggtgctgggtgaaaggctaattgtgagacgttgaggagtggacgggggtggggaatggagatagggttggaaacttattccagaagtttggctgtgaagagcaacttgtgttgcggaaccagaggactaactcagcatatcaccctggagtgttgattggacttgaatatttgcgcagactcattattttcatgtgaaaataaaccaatgataagacaatagatatgtcatagattagcgagctctcaggatggaggagagagagaagatggaaatattaggtttgggctaaatattgaggactttccttttgcgaggcactgtaatccctttcacatgttgttatctcacatagtcctcaaaatgagcctatggtgtgtatatctggaattttcctcatttttgtggatgagtaaactgaggcttagagaggcatggttgcaga

SEQ ID NO: 82022 - DNA, 390 bp, Homo sapiens
ttttgggttggggggcaaggtcttgctctttaacccaggctggaatgcagtatcactatcgtagctcacttcagccttgaactcctgggctcaagtgatcctcccacctcaacctcacaatgtgttgggactataggtgtgagccatcacacctggccagatgatggcttttgagtaaagacctcaagcgagttaagagtctagtgtaagggtgtatgaagtagtggtattccagatggggggaacaggtccaaaatcttcctgtttcaggaatagcaaggatgtcattttagttgggtgaattgagtgagggggacatttgtagtaagaagtaaggtccaagaggtcaagggagtgccatatcagaccaatactacttgccttgtagat

SEQ ID NO: 82023 - DNA, 177 bp, Homo sapiens
tgtggaatgggaaaagatgacagtcttctttaaaaggatctttaaggaaaggagagttctatcattttaaggtggctggggaactgtctggcattaagagagaggaatggattacacagatgatttctggtgtttttattagtattgttgttactctggttcaatgattctgtgatt

SEQ ID NO: 82024 - DNA, 741 bp, Homo sapiens
aacggggacggtggtggggggcagtcttcatctaaatacagttggtgttaaaaggagaagcagaggaggagaagggacaggcaaagcagctttctcttctaaaataaatccaaattcctgggaagaagctctgaggtcattcactcccccagatggcccagtgccaccaacctgatagagcccactcagcaggtgcccaaaagctcaactgtgaatccctgacagctgtgatgccaccaactctcttctagctctaggaagcaaaggagctcaggagcaggcagggtgctgcccaagaaataggtatgaacagagacctttcactttcaggacctgggtccttttttttttttttttttttataaacaggaaaaacacattctaaatgaaaacagtctgttccctttggaagtggctaaactagtcttattttaattaactagctgaaatacacctgctaaaaacaacacacctttgctatcttgggaatactctttgaatatctgggttttaaacagcccatcccctcttacatttgaagtgatcaaagcaagacagtcctgtacccagagttttaattcattacactacacttgcatttttcctgtgggcagagaaaggaaaacctccaatgccacccacctgaagtgcatatttgtcttgcagttataccatccactcagtggagttcagggctccatatctggcatcaatagcaaaataaatttccaaacactgtaa

SEQ ID NO: 82025 - DNA, 3985 bp, Homo sapiens
  misc_feature (3920)..(3920): n is a, c, g, or t
  misc_feature (3938)..(3938): n is a, c, g, or t
acccacgcgatcgcggacgcgtggtgtcgacccacgcgtccgaccacgcgtcagcgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaatgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82026 - DNA, 4007 bp, Homo sapiens
  misc_feature (3942)..(3942): n is a, c, g, or t
  misc_feature (3960)..(3960): n is a, c, g, or t
gtggtgagcgtggagcgggaccgagagcgggagcgccggcagagggagcgcgagcgagatgcgggagcgcgagcgcgacaaggagcggcagcggaggaaggaggagtgggagcgtgagcggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaatgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82027 - DNA, 3862 bp, Homo sapiens
  misc_feature (3797)..(3797): n is a, c, g, or t
  misc_feature (3815)..(3815): n is a, c, g, or t
acccacgcgatcgcggacgcgtggtgtcgacccacgcgtccgaccacgcgtcagcgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaatgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgaaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82028 - DNA, 3598 bp, Homo sapiens
  misc_feature (3533)..(3533): n is a, c, g, or t
  misc_feature (3551)..(3551): n is a, c, g, or t
acccacgcgatcgcggacgcgtggtgtcgacccacgcgtccgaccacgcgtcagcgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaatgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82029 - DNA, 3927 bp, Homo sapiens
  misc_feature (3862)..(3862): n is a, c, g, or t
  misc_feature (3880)..(3880): n is a, c, g, or t
acccacgcgatcgcggacgcgtggtgtcgacccacgcgtccgaccacgcgtcagcgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaatgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82030 - DNA, 3698 bp, Homo sapiens
  misc_feature (3623)..(3623): n is a, c, g, or t
acccacgcgatcgcggacgcgtggtgtcgacccacgcgtccgaccacgcgtcagcgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaatgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaggngtctcctaaaataaaatattttgataaggtaaaaaaacacacccccctccatgcgcccgcttggccagtcgattt

SEQ ID NO: 82031 - DNA, 4196 bp, Homo sapiens
acccacgcgatcgcggacgcgtggtgtcgacccacgcgtccgaccacgcgtcagcgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaatgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaataccaccttttggtaagccccatccaccctccctctccctccccccttccccaccctcgtcacctgctactcccctccccttccccattccgtcccctccctccccccctccttcacaagcttcgccctatcccgccactccctcacgtctcctccacaccccccatctcgactccgtatccgactccgctgctcctacactacccctctccatctctacctcctctcccctccctcacttctcctctccacactcctcttccctcgttcctgcgacccctcgctatcatccaccccccatcctctcttccccttgcctcccactatcccgccatctctctccctcccccacatctcttcactctatccccaccgaccctctcctcactcgactcctccacctcccctcatcctccacttgctctcgtcgacccgccgtcaccctgctacctcctcatctccttctctcatgctcttctcactactcagctgcactctctattccaccacctcactctccccactcactcctctcatccctcccgacattccaccccctcgccg

SEQ ID NO: 82032 - DNA, 2562 bp, Homo sapiens
  misc_feature (2497)..(2497): n is a, c, g, or t
  misc_feature (2515)..(2515): n is a, c, g, or t
gtaccggagcaaggaacgggggaatgtaagagaaccatatgggcagggcagactcaggtgccagtcctgtgtgctttgtgtccgtgttgagtgcacgccagtgaagctacagacctgctgtttccagtctgtctgccgtgtgttcctcaggcattccctgagactgcggaattgctccttgtgtttttaatttccctgtgggctgaggctatctcccttttgtctaagccagggactctgcttaaattccatccttgccgctgttgagtcagctcagtcctgtttcccttcccaaaaagcaacctgacattcgttttgttttttgtttgttttgagacggagtttcactcttgtcgcccaggctggagtgcgatggcatggtctcggctcactgcaacctccacctcccgggttcaagcgatttttttgcctcagcctccccagtagctgggattacaggcgcctgcgaccacgcccggctaatttttgtatttttagtagagatggggttttaccatgttggccaagctggtcccgaactcctgacatcagttcagctgggtctcagaccccattgctcgtgacgagatctgcccatctcagtctcccagagtgctgggattacaggcgtgagcagccgtgcctggctgcaacctgacattgattagtgaaatggggccctggcctagccatggggacgtcccttactttgtaaccctgaaactgcccagtgtccccccaaaatcacacattccgtgggtacatgatccataaatggacactgcgtaaaagtggaccatggagcaccccctgctggcccctccctccagtctggctggggtgtggtgagatgtgcttgtgtgtccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82033 - DNA, 1444 bp, Homo sapiens
  misc_feature (1379)..(1379): n is a, c, g, or t
  misc_feature (1397)..(1397): n is a, c, g, or t
gacctttgggagcagagcaggttgctggcaaggaacccatgtcctctggggcgaggacacggcttctggctcctggccctgctgtcctcactggcctctctcttgtcccaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82034 - DNA, 1432 bp, Homo sapiens
  misc_feature (1367)..(1367): n is a, c, g, or t
  misc_feature (1385)..(1385): n is a, c, g, or t
ctcatttccagatgccttggtgcccacatctctcttctcctacttggctctcccctttttatttctttataaaaatgaaggtggtgaactaagcagcctcaggctttagaagtgagtccctggcatcggtgaggccacccacacagccattccctgtacatcaggagggtggtctcactctgtacctatcacccaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82035 - DNA, 2593 bp, Homo sapiens
  misc_feature (2528)..(2528): n is a, c, g, or t
  misc_feature (2546)..(2546): n is a, c, g, or t
acccacgcgatcgcggacgcgtggtgtcgacccacgcgtccgaccacgcgtcagcgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaatgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggactgccaaattttccggtttgccccgggatattatagaaaattattagtatgaataatgcaaataaaacacacctcgtggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82036 - DNA, 1600 bp, Homo sapiens
acccacgcgatcgcggacgcgtggtgtcgacccacgcgtccgaccacgcgtcagcgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaatgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgaaagtatgacttcaatatccacatatgaacttcatgatctgttcattcaagttatccctttttatttacagtaaaaaatacagggctttatatgagcttatagagccagcacaatgtaccaatttgaaaaccaaattgattgttacggagaacgaattcagaggcagcgattacattaatggtcatttgaacaaagacttgcctgaaaactg

SEQ ID NO: 82037 - DNA, 3890 bp, Homo sapiens
  misc_feature (3825)..(3825): n is a, c, g, or t
  misc_feature (3843)..(3843): n is a, c, g, or t
ggcagtgcacgctgctgctgctggttgactcttgagtatcccctggagcggttttctctccgccctagcgctgataaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaatgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82038 - DNA, 2121 bp, Homo sapiens
  misc_feature (2056)..(2056): n is a, c, g, or t
  misc_feature (2074)..(2074): n is a, c, g, or t
tggaatgtcatacaggggacgcagtttcttggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82039 - DNA, 3831 bp, Homo sapiens
  misc_feature (3766)..(3766): n is a, c, g, or t
  misc_feature (3784)..(3784): n is a, c, g, or t
acccacgcgatcgcggacgcgtggtgtcgacccacgcgtccgaccacgcgtcagcgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaatgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacataggaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82040 - DNA, 3309 bp, Homo sapiens
  misc_feature (3244)..(3244): n is a, c, g, or t
  misc_feature (3262)..(3262): n is a, c, g, or t
gagatggggtttcaccatgttgcccaggttggtctcaaactcctgagctcaggcattccacccaccttggcctcccaaagtgctgggattacatgcgtgagccgccgcacgcagcctaattttgtatttttagtagagactgggttttaccacgtttctgatcttgaactcctgacctcaggtgatccatccgcctcggcttcccaaagtgctgggattacaggtgtgagccactgcacccagcccagaaattttttttaattagctgggtatagtggtgtgtgcctatgatcccagctacttgggaggtcaaggttgaatgagctgtgatcacgacattgcattccagcctggacaacagagatcctgtctcaaaacaaaaaaaaaggatttttgctatttagttgttttaaaagaaagtattaaatcagtccttagattccttgcatagaactctttcatttccaggcagcaggtcgtttatatatttgtcacagttctttgtttcttttgtttgttttgtttctggagagacatggtcttgctgtgttgcccaggctggtctcaaactcctgggctcaagtgatcctcccaccgtggtctcccaaactcgtgggattataggcatgagccaccgcgcctggcctaaatgtttcttaataagtctgaaatgttttaaagacctgacttttgaaaaaaaaaaatggttctcttacattcccccgttccttgctccggtacccaatgtacctggaagacgtggttggtgttttctcgagcagcatatgggcagggcagactcaggtgccagtcctgtgtgctttgtgtccgtgttgagtgcacgccagtgaagctacagacctgctgtttccagtctgtctgccgtgtgttcctcaggcattccctgagactgcggaattgctccttgtgtttttaatttccctgtgggctgaggctatctcccttttgtctaagccagggactctgcttaaattccatccttgccgctgttgagtcagctcagtcctgtttcccttcccaaaaagcaacctgacattcgttttgttttttgtttgttttgagacggagtttcactcttgtcgcccaggctggagtgcgatggcatggtctcggctcactgcaacctccacctcccgggttcaagcgatttttttgcctcagcctccccagtagctgggattacaggcgcctgcgaccacgcccggctaatttttgtatttttagtagagatggggttttaccatgttggccaagctggtcccgaactcctgacatcagttcagctgggtctcagaccccattgctcgtgacgagatctgcccatctcagtctcccagagtgctgggattacaggcgtgagcagccgtgcctggctgcaacctgacattgattagtgaaatggggccctggcctagccatggggacgtcccttactttgtaaccctgaaactgcccagtgtccccccaaaatcacacattccgtgggtacatgatccataaatggacactgcgtaaaagtggaccatggagcaccccctgctggcccctccctccagtctggctggggtgtggtgagatgtgcttgtgtgtccaggtccctgagcgtgagcagcgtctcctcagtgtccagtgctacgtcgagcagcagctctgcacacagcgtggactcggaggacatgtacgcagacctggctagccccgtgtcctcagccagctctcggtccccggccccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82041 - DNA, 1745 bp, Homo sapiens
  misc_feature (1680)..(1680): n is a, c, g, or t
  misc_feature (1698)..(1698): n is a, c, g, or t
ggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagcccagaccaggaaggagaaaggaaaatctaagaaagaagacggtgttaaagaggaaaagcggaaaagggattcgtccacacaaccacccaaatctgcaaaacctccagcaggggggaagtcctcccagcagccctcgacaccccagcaggcaccccccgggcagccccagcagggcacatttgtggcccacaaggagatcaagttgacactgttgaataaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggacgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccgtcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82042 - DNA, 2854 bp, Homo sapiens
  misc_feature (2789)..(2789): n is a, c, g, or t
  misc_feature (2807)..(2807): n is a, c, g, or t
acccacgcgatcgcggacgcgtggtgtcgacccacgcgtccgaccacgcgtcagcgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaatgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggacgctaagcggcagcggcagtggcagtggtagcagctatagtggttccagctcccgatccagctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgatttaaaaaggaaaaaatacagaaaagaccaaaaaaaggccaagggtgttgttggggcgtctgtctaatgtggtgggtctttttttgaggggtctcctaaaataaaatattttgataagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaacaaacaaaaaaaaaaccaaacacaaaaacaacccacaacccaaacaaaacaacanacccaccaaaaaaccccnccccaaccaaaaaaaacccaacaaaaaaaaaaaccaccaccacccac

SEQ ID NO: 82043 - DNA, 2410 bp, Homo sapiens
acccacgcgatcgcggacgcgtggtgtcgacccacgcgtccgaccacgcgtcagcgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagggaactgtacctggggaatgaatgtaggtttatacaccctggagtgaacgacaaggggaactactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgggagcgagagagagagaacagacagcgcgagcgcgagcgggagcgggagcgggaccgagagcgggagcgccggcagagggagcgcgagcgagagcgggagcgcgagcgcgacaaggagcggcagcggaggaaggaggagtgggagcgtgagcgagccaagcgggacgagaaggaccggcagcaccgtgaccgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtgcgcctggtgcagaagtgcgcctgggtgcgcacccaggcgcacttctccctgccaagtcgatccaccctgtctacactacctgcctggccagaagatccaccctgtctacactaccttccttgccagtaatgcacgctatctacactatctgcctggctagcagatccacgctgtctatactaccttccctgtccagtagacccaccctgtctatactacctcctggccagcagatccagcctgtctatactacctgactggccagcagatccacctgtctacactacctgcctgcacagaagtgcgccttggtcaggctc

SEQ ID NO: 82044 - DNA, 486 bp, Homo sapiens
ttctcctccctgtcacctcctcccctaaaccttgacctcacactccctttcccaagacttgctccttaacaaaattcaggcaactcccctgaaccacgtgggcagagtccccttccctccaaatccctgaccctcctgtccccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctacaaaaaaaaca

SEQ ID NO: 82045 - DNA, 340 bp, Homo sapiens
gcttcaccttgagacgcttattatgttccctcaaaaacttcgggaccccaggcctgtatggcctctccgttctccgttccatgatcgtactggaacccttcggtgaaggggagaatgtgcaacgagtgcgaggtcttcagccctaattcttcagagaggtgaacgtctatggagtcactgtgccaggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagacc

SEQ ID NO: 82046 - DNA, 177 bp, Homo sapiens
agggatcttttctataccagacagcccagtacacctgcaacggcccccaccccacagagttcctctctcaggtgtactgggctgtcagggatcttttctataccagaactgcggtcactattttgtaataaatgtggctggagctgatccagctgtctctgacctacaaaaaaaaca

SEQ ID NO: 82047 - DNA, 2398 bp, Homo sapiens
tgcaggctggtactggtcccgaatcctttagatgtccggggccgccccacacccgcactcctcccgggtttctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctacaaaaaaaaca

SEQ ID NO: 82048 - DNA, 2366 bp, Homo sapiens
tgcaggctggtactggtcccgaatcctttagatgtccggggccgccccacacccgcactcctcccgggtttctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccagaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctacaaaaaaaaca

SEQ ID NO: 82049 - DNA, 2600 bp, Homo sapiens
tgcaggctggtactggtcccgaatcctttagatgtccggggccgccccacacccgcactcctcccgggtttctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccaggtgcctaggcatggaaggtgggggaggcacccagccaccaccccgaattggtagtacttgggcgcagggagcacgaggccttcgtggtggtcagccatggaggggcttactctgtctcccacacccaccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctacaaaaaaaaca

SEQ ID NO: 82050 - DNA, 2425 bp, Homo sapiens
tgcaggctggtactggtcccgaatcctttagatgtccggggccgccccacacccgcactcctcccgggtttctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccaggtgcctaggcatggaaggtgggggaggcacccagccaccaccccgaattggtagtacttgggcgcagggagcacgaggccttcgtggtggtcagccatggaggggcttactctgtctcccacacccaccagggcatgaaggcagggctggaatggcagccctagttctgcgtcccccccacgctttggacaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctacaaaaaaaaca

SEQ ID NO: 82051 - DNA, 754 bp, Homo sapiens
cccataaggccctgacccctgactcccagtttcagatctctgctctctgacaggtggaagggggagaatgtggccacaaccgaggtggcagaggtcttcgaggccctagattttcttcaggaggtgaacgtctatggagtcactgtgccaggtgcctaggcatggaaggtgggggaggcacccagccaccaccccgaattggtagtacttgggcgcagggagcacgaggccttcgtggtggtcagccatggaggggcttactctgtctcccacacccaccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctacaaaaaaaaca

SEQ ID NO: 82052 - DNA, 1136 bp, Homo sapiens
tgcaggctggtactggtcccgaatcctttagatgtccggggccgccccacacccgcactcctcccgggtttctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaatgtggcctcttctgatgctctgctggccctgggcctgctgggcttgcctgccctgacccccggaagggtccccgatcgtgctgtgtggcttgccaggccccttggcccctgggctagccgttctgaccggtggaaaccttgtacgcccaatgcaagtgtcgggccgggccccttggcgaggccaaaccaaacccccgttattctccttccaagttttacaacctaggtggctttctctggcctgggaggccaggccttattttaaaggccgcttaaacccgttcccaaggggaaaggcggggcctcgggggaaagcggcccgttgggccctcggggaaaaggcgcaaagaaggtcttttaagagaacaccccaaaatgggcctagggggccccattttgtgggccagagcacctagtgcctggacccccctctttctacacccagctttaaaccacggatttagacccttggcccagcttaagggggaggacccatttggacgggcgggaaaccccatttgggcggcggagagagaaaacccccccccactggagaaccggggggggagccgggagtggtccagggggaaacccaaaagaggggccccgcgggtggtgcccggggaaaaacgggcgcggcagagcggggcagaaagggggcccggagggcccccgttgtggggggcggcagaacgcggaaacaagaacgggcgtgcccagtagagcaggacctggggggggagtgtcccaacg

SEQ ID NO: 82053 - DNA, 223 bp, Homo sapiens
cctgctgggcatcgtgggctgcatgggcattggtcagtctccccaaccccaccttcattaattcatccagtagacatttattaagcacgtactatggtgtgagtcctccagggtagataatctagaggacggatggggcagagccctactcaccaggagctctgtacaatagggcaatgtcacctgcctagacctacagactgaggaacggtgaggggggcca

SEQ ID NO: 82054 - DNA, 721 bp, Homo sapiens
tttgggagagagcaatggtaccttcccttaacgggaaaacgagaaatattgaggggaagatggactgcgatccaaacgccctggctctcaggcctggactctagggcttagccagatgcctaaaccgcccaagccgagaaacaacttagaagacagacataaccctgggattcagggaaggcgcgagcaccgcccaggacctggtagggtgcgagccgcgagcagtccgggagggagcgcgcctagggcggagcgtaggctgtggggggagggctgggagtccggggccgccccacacccgcactcctcccgggtttctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactg

SEQ ID NO: 82055 - DNA, 2469 bp, Homo sapiens
tgcaggctggtactggtcccgaatcctttagatgtccggggccgccccacacccgcactcctcccgggtttctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctacaaaaaaaaca

SEQ ID NO: 82056 - DNA, 2765 bp, Homo sapiens
tgcaggctggtactggtcccgaatcctttagatgtccggggccgccccacacccgcactcctcccgggtttctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgggcggggcttaccaattgccttggcttacaaacaaacaaatccgtaatcttttcaatctatcctaaaatggcttacttgccaaccccataggggggtataaaaaagggccggctataaactccgtgtgggaaactctgttccacttaaaatctcggtcccttctcgtgttgtataagaaagacccactatgtcttctacaagtgaccctctctgagcataaatactgacatttgtcctcgtcatgttaaccgctctctcacttgtcctagcctctggcgagattcttattacatctcatcatgtgtggtgctcttgcagaactttgacgctatcctccc

SEQ ID NO: 82057 - DNA, 504 bp, Homo sapiens
tggtactaactctttgaaatctggtatttattttacacttctagttcgtctcaattcaccttgccacaatttaagagctgtatatgcacatgtaactagtatatgctgtattggtcagagcagttctagaggggcatactctcctcctcccccactaaactagtgtgttggtcccctaccccctccctgtcatgcattcttttcaggaagacacttttgagagcatttaatgttttcctcccagattcaacttttgcgctcacagtacactgctagttttcaaatgatcagaaatttttttttttctcggcaactccagttatgaattagctatccagttagtgtttgtgattgttttgagacttggcagtgtttgttcttatgatttatcttcttttctcacacatttcagggatatattagtttcctttatccagtagctaaaaaccttgtttattttattttaatattttagcctaacaagacagtgaaccagctgtagaa

SEQ ID NO: 82058 - DNA, 1705 bp, Homo sapiens
ttcatggtctcctggaagctttggctggagactactcagctcgtcactgaactaacggcttttgggggttcttttttcccagttgagtttctgtgtcttttacacgtttggttttatggtccgttggaggttttttcacgctgagggtgaagattcttagtttcctcaattagcataaaagctgctccaaggctgctgagtcttcagttccattccattcaaaatgttaattcctgagacacgcaacctacgccctactgtcctttgtcccacggcttctcgagattatctctgtgttttaatagataaaacgccttctctccccacccgtggggtgcaaagcacagcgcatggggctggtggcgcccgagagcatcacacaacgcatgcgccagtccgcaggtgtgggcggaggagaaatcgcgtcggcggcaggggatgacgtaaaaaggccgcgctgtactgcggcttgtgccgcttccgcaagaaggtttcctggcctgttgcagccatggtgcattgcagttgcgtgtgttcagaaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgggaaatccctgtgcctgtgggtatttcagtaactgatgaaaatggtaaaattataggagaactcagtaaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttgctaagttgtgtttctcatgcaaaacctgcaattgcagattacgcatttacaacattaaagcctgaacttggaaagataatgtacagtgatttcaaacagatatcagtagctgatcttccgggtttaatagaaggagcacatatgaacaaaggaatgggccacaaattcctcaagcatatagaaagaactagacaactactttttgttgttgatatttctggatttcagctttcttctcacactcaatacaggacagcttttgaaaccataatactgcttacaaaagagttggaattgtacaaagaggaacttcagacaaaacctgcactcttggcagttaataaaatggacttgccagatgcccaagataagttccatgaattgatgagccagctccagaatcctaaagattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagta

SEQ ID NO: 82059 - DNA, 1217 bp, Homo sapiens
ttcatggtctcctggaagctttggctggagactactcagctcgtcactgaactaacggcttttgggggttcttttttcccagttgagtttctgtgtcttttacacgtttggttttatggtccgttggaggttttttcacgctgagggtgaagattcttagtttcctcaattagcataaaagctgctccaaggctgctgagtcttcagttccattccattcaaaatgttaattcctgagacacgcaacctacgccctactgtcctttgtcccacggcttctcgagattatctctgtgttttaatagataaaacgccttctctccccacccgtggggtgcaaagcacagcgcatggggctggtggcgcccgagagcatcacacaacgcatgcgccagtccgcaggtgtgggcggaggagaaatcgcgtcggcggcaggggatgacgtaaaaaggccgcgctgtactgcggcttgtgccgcttccgcaagaaggtttcctggcctgttgcagccatggtgcattgcagttgcgtgtgttcagaaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgggaaatccctgtgcctgtgggtatttcagtaactgatgaaaatggtaaaattataggagaactcagtaaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttgctaagttgtgtttctcatgcaaaacctgcaattgcagattacgcatatacaacatttaagcctgaaacttgaaagataatgtaagggatttcaaaagagtttctgagagggaactccggggtgaaggggagcctttataacaagggaggggccaaattcctagaggtttgaagaatagtactaaggtgtgatattcggatcaggttctctaactt

SEQ ID NO: 82060 - DNA, 1841 bp, Homo sapiens
ttcatggtctcctggaagctttggctggagactactcagctcgtcactgaactaacggcttttgggggttcttttttcccagttgagtttctgtgtcttttacacgtttggttttatggtccgttggaggttttttcacgctgagggtgaagattcttagtttcctcaattagcataaaagctgctccaaggctgctgagtcttcagttccattccattcaaaatgttaattcctgagacacgcaacctacgccctactgtcctttgtcccacggcttctcgagattatctctgtgttttaatagataaaacgccttctctccccacccgtggggtgcaaagcacagcgcatggggctggtggcgcccgagagcatcacacaacgcatgcgccagtccgcaggtgtgggcggaggagaaatcgcgtcggcggcaggggatgacgtaaaaaggccgcgctgtactgcggcttgtgccgcttccgcaagaaggtttcctggcctgttgcagccatggtgcattgcagttgcgtgtgttcagaaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgggaaatccctgtgcctgtgggtatttcagtaactgatgaaaatggtaaaattataggagaactcagtaaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttgctaagttgtgtttctcatgcaaaacctgcaattgcagattacgcatttacaacattaaagcctgaacttggaaagataatgtacagtgatttcaaacagatatcagtagctgatcttccgggtttaatagaaggagcacatatgaacaaaggaatgggccacaaattcctcaagcatatagaaagaactagacaactactttttgttgttgatatttctggatttcagctttcttctcacactcaatacaggacagcttttgaaaccataatactgcttacaaaagagttggaattgtacaaagaggaacttcagacaaaacctgcactcttggcagttaataaaatggacttgccagatgcccaagataagttccatgaattgatgagccagctccagaatcctaaagattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagtatttaatgcttaaaaacaaggaaatcctttcatctgtgacaacctggaggacatgttaagtaaaataagccaggcttagaaagacaaatgctgcataatctcactgtggaatcttaagttgaactcatagaaggaga

SEQ ID NO: 82061 - DNA, 1631 bp, Homo sapiens
ttcatggtctcctggaagctttggctggagactactcagctcgtcactgaactaacggcttttgggggttcttttttcccagttgagtttctgtgtcttttacacgtttggttttatggtccgttggaggttttttcacgctgagggtgaagattcttagtttcctcaattagcataaaagctgctccaaggctgctgagtcttcagttccattccattcaaaatgttaattcctgagacacgcaacctacgccctactgtcctttgtcccacggcttctcgagattatctctgtgttttaatagataaaacgccttctctccccacccgtggggtgcaaagcacagcgcatggggctggtggcgcccgagagcatcacacaacgcatgcgccagtccgcaggtgtgggcggaggagaaatcgcgtcggcggcaggggatgacgtaaaaaggccgcgctgtactgcggcttgtgccgcttccgcaagaaggtttcctggcctgttgcagccatggtgcattgcagttgcgtgtgttcagaaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgggaaatccctgtgcctgtgggtatttcagtaactgatgaaaatggtaaaattataggagaactcagtaaagaaaatgacagaattttggtagctcaaggaggtcttggtggtaaattacttacaaatttcttaccattgaaaggccagaaacgaataattcaccttgatctaaaacttatagctgatgtaggcctagtaggttacaacattaaagcctgaacttggaaagataatgtacagtgatttcaaacagatatcagtagctgatcttccgggtttaatagaaggagcacatatgaacaaaggaatgggccacaaattcctcaagcatatagaaagaactagacaactactttttgttgttgatatttctggatttcagctttcttctcacactcaatacaggacagcttttgaaaccataatactgcttacaaaagagttggaattgtacaaagaggaacttcagacaaaacctgcactcttggcagttaataaaatggacttgccagatgcccaagataagttccatgaattgatgagccagctccagaatcctaaagattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagta

SEQ ID NO: 82062 - DNA, 845 bp, Homo sapiens
ttcatggtctcctggaagctttggctggagactactcagctcgtcactgaactaacggcttttgggggttcttttttcccagttgagtttctgtgtcttttacacgtttggttttatggtccgttggaggttttttcacgctgagggtgaagattcttagtttcctcaattagcataaaagctgctccaaggctgctgagtcttcagttccattccattcaaaatgttaattcctgagacacgcaacctacgccctactgtcctttgtcccacggcttctcgagattatctctgtgttttaatagataaaacgccttctctccccacccgtggggtgcaaagcacagcgcatggggctggtggcgcccgagagcatcacacaacgcatgcgccagtccgcaggtgtgggcggaggagaaatcgcgtcggcggcaggggatgacgtaaaaaggccgcgctgtactgcggcttgtgccgcttccgcaagaaggtttcctggcctgttgcagccatggtgcattgcagttgcgtgtgttcagaaagtatggaaatttcatcgataagctaagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgggaaatccctgtgcctgtgtacctgtgaaagtagggatcctctagatcacctcagcatcagctgcctgcctt

SEQ ID NO: 82063 - DNA, 411 bp, Homo sapiens
ctgcgtagctgtgctggcaaaggagagcctgggcgtctgggcagttctgagggattgagccataaagggaagggtccctggctgtggaatgactgagcgggcggagaagccctgtgtgggtggtggggaagaagagtccatcccacccaggaactgaagatagacacctcaggggtctgttagacccttgagagagcaggggcagtggcggcttgggtgtaagaaggagatgtgcagaaggagggtgcagtggctgctacttccttgtggggccagtttctccagggatggcggggaccctgaactccatagccctccccagctcacactgctggagtcttcaccaaaccccactcactgccttttaggagcagccctgctgccctaacgagggctggctggaacaactct

SEQ ID NO: 82064 - DNA, 925 bp, Homo sapiens
gcttaagccgtgcgcccaaggcagcgtaggagcgttgctgccaggccttggggcagggattcccaccgagcccctcttccccagcaggagggcaccacccatcttgatggcccaactcactccaggaaacacaatgggtttgctgaccgtggcggatgagagtggcggcaggtgcgaggggagagaacattgagcatttgaagcttcgacttgaggctcggccaccgactttgctgtaatgggtccgctcctgtttctgcctccgcgtgagggttgcggccacagggtgacggcgtggtgggcgacacccccgcgcaggcatgcacagagtggtggtcgttggggggatcctctacacagagccctcagagacccctccctgaggagtccaaacctgtggagatgcccttccaccactgacacaggagaccccacttccgacgccgggccttaccacctgagaggcatgcatgcaacggaggcagctatatgctgcctgtgccgcattgctttgtcttcatggctggcggaggtggtcagaatcacatacataacaccctggacaggcgggtatctggcacaccagcctggcatcatgaccgatgcagacccacttgctggcggcatgttggggcagcatgatgggcaagccacattatacccatctgggtctccaacacgtcacagacacccggaaccatgaccctatggtctggcaccgatccagacacatcttggggtgatttagggcacctcctgtggtcttcccctcctggcattcggtcactggggatacgtcctggtaccatggccttcagtccggacctgattgcaacagcgacgtacaacaatcgaggggcagatgccaaggactgcagacccagcagacagtcgcaagactagtgccacacctgtaccgaaccga

SEQ ID NO: 82065 - DNA, 764 bp, Homo sapiens
attacaggcatataccaccatgcctggctaatttttgtatttttagtagagatacggtttcgccatgttggccaggctggtctcgaactcctgatctcaggtgtgcacccacctcagcctcccaaagtgctgggactacaggtgtgagttaccatgtctggtctgggctttcagtgtaaccatcaccaagtagtgtacattgtacccattaagtaatctctcctccctcaccacctcccaccctacgtagtctccagtgtctcttatttcatactctgtgtccatgtgtatacattgtttagctcccacttataagtgagaacatgaattatttaactttgtttaaaagctttttttaaaaaaaattggtggtagggaaggggacatgtgttttaaacggaatacattaactaatccgatataaacaaattgttaaaaggtttttggctttggttttgttttaatttttttttcttcttttgaggcagagtctcgccgtgtcacccaggctggagtgtagtggcgcaatctcggctcactgcaacctccacctcccaggttcaagtgattctactgcctcagcctcccgaatagctgggaatacaggcacccgccaccacgcccagctaatttttgtatttttagtagagatgaggtttcaccatgttggccaggctgctcttgaacttctgacctcaggtgacccacccgcctcggcctcccataatgttgagattacaggtatgagccaccttgtccggcct

SEQ ID NO: 82066 - DNA, 421 bp, Homo sapiens
gtgaaaaactacaaaatgctgatgaaagaaaccaaagaaaatctaaataaatggagagatagtccatcttcaaagattggaagattaaatatagtaaagatgtcatttctccctaaatttgtatacatatataccatagtttctattaaaatcccagcaaaattgtcgatatagacgatcttctaaaattttatatagaaaagcaaaggaatacctactacaaatctgaaaaagaaagtgggaggaatcactatccaaattctagacttatatagctatagtaatccagactcagtggcgttaccagagggatatatagatgactagaacagaatagggaagccagaaatagccccatataagtatggccaatttgtttttgataaaggtgcaaaacagttccaatggaagaagcatagtc

SEQ ID NO: 82067 - DNA, 683 bp, Homo sapiens
cactcttatatctgtgattcattctgagttttcttgtatagtttaaagtcagagtgggtgtttgtttgcttattaatatatttatagatatttctaattctttctagcaccatttattaaaaagtctctttttttacccattgaattattttttttaaattgttatgtctaaaatcaaattaccaaatacacattgtctattttgaactatttattctgtttcattgatttttatgtgttcctttacacccaatatcattgtcttaattactgtagatttgttggaaatatgggagtcaaatttaaggatttcaattttgtccttttatcaagttgttttggctgttctaggtcctttgccatttccctataacatttggaattaggttgtcaatatttccccagaataaagcctgctgggattttgaacaggattgcatggaatctataaatcaatttagtgagaattaataacatattaagtactctaattgatgaacatagtatcatcttccatttatttagtctttgacttctcggaaatgttttatagttttcagtgtgtaggtcttgaagtttgtaaaattctaagtgttttatggttttgactgtaattgtaaatacctcccattgttcattgttagtacatagaaataaaataaattttgtattaatttgtctca

SEQ ID NO: 82068 - DNA, 767 bp, Homo sapiens
ggtgaaataaaagtattttgatttggaggaaggaacttaatactaaaaatagtctcaatggaatagattgcagggatacctgttattatcagtaattctgtgatagcgaaacaaacataattgttactgtgtattgggtgctcactctgttccaggaaagtactataaagtattgtatttacgtaaattattgtatttaatactcatagtgtccctgtgagcggtaataacattaccattttacagatgggaaaactgagactcagagaattaaataccagcctcaaatcacgtagctaataaagaggtgaatctgctcaagctgtaaaccatgaggccagctaggcataggggatgtgttctgggatgaggattcttttacattcttcctcagtgagactcccctcccctcttcttagaagaccagggagctcttgctttacttttttaccctttccctgcccagggtggatgaatattattccttggactttataaggctgtggccctagatgctgagtccctgtcttctggtgtctgggaagtgtggcggccccttggccagtccatttctttagtcgttctgtcactcttcctcaatggatactgccccagtgtagaggaatccagaacataccccaagcagtccctccctgtacagtttcactttattaaaaggattataattagggtttcattggatgttttattattccccatgcttttttcctgatggaaattatttcgttgttgagacagagcctcgc

SEQ ID NO: 82069 - DNA, 344 bp, Homo sapiens
atatgataaccataagctttatttaactataattttctatattaacaagctcctttcctatttatctaaatcaaatggcttttattccacaccaataacctgcaaatatgactgccttggactcacaactcacccctaaggaatctgccttatgtttggaatcttattttcactgcattaaagcagtacagaaaaaacattaccatatatatgacaaggaataagaagattcacaaacgtaaggatagcataaactcattgttcaggaatgtgattggttaccccatctaacagtctggtgaaaagtgcccagggaaatgaacacacaacacagaaatacagtc

SEQ ID NO: 82070 - DNA, 221 bp, Homo sapiens
aaactcaggcaaacccaaatccagggatgttattcaaaataactggcctgtaatctttaaaagtgtcaagatcatgacagtgaaggtaaaaaggaagaactgtcccagtctgaagaaggatagagaggaagacatgacaaccaaatacaacacatgattctgaagtagatccttattctataaagggaatttgggggcaactggtgaaaatttaatttttt

SEQ ID NO: 82071 - DNA, 768 bp, Homo sapiens
gccgcatccttgaactcctgggctcaagcgatccttcttccgtagcctctggagtagctggaaccacagacacaatgctactgcacctggcttttgttttttcttatagatttgctggacggccacagtggctcacaccttgcctatactttggaaggctgaggtgggaggatcacttgagcccaggagtttgagaccagcctgggtaacacagtgagtccccatctctacaaaagaaatcagctgggtgtggtggtgtgtgcgtgtaatcccagctgcttgggaggctgaggtaggagaattgcttgagctcagaaggttgaggctgcagtgagctgtgatggcaccacttcactccagcctacacaatagagcaagaccctggctctcataacacacacacacaaaagacttgcctcattcatataacatcagtaaaaaccctcctaaattctaaaggcaggcaaagttaatatcattttaggattatattcctgtaatcctagcactttgggaggctgaagtgggaggatcgcttgagcccaggagtttgaaaccagcctgggcaatgtagtgagaccccatctctattaaaaaaatttttttttaattttaaccttgaggtttaagggaaatttattatagaacttttggtattgtatatatatatataagttatatttgtatacgcagcttatggtagatggacattccttatataaccaagatatggtacataaaggcccttttatttttaatgagtatgga

SEQ ID NO: 82072 - DNA, 446 bp, Homo sapiens
gccggctgaccagggggtgggccgcaccacggagctgccacctgacccatgtttcctgtgtcgagagcacaagaaccagtcatataaatggctctttcccagagaagctttgtagaggaaattccatttcagcaaagaaggtggactggggatgctctggaagatgagaaaggaagccaagagtcaaaacagcctccgctggcaggagccctgtggtggcggctgagctggcaccctaataaggggcactgagccctggtgcagggctggctgggcagcactcagctctaccctatctgcttctcccacccacgcttcacgctggctttgttctctcttccacactgagaagaacaaaaccacttatctgtatcaagttcctaaactggggtaggggacaagagtggggaggggcccggtatccagcttgcaatcacagggcgtga

SEQ ID NO: 82073 - DNA, 167 bp, Homo sapiens
taacacctggttgaactttccttttttagtccattagcattcgctgagcctatgaaccacgcttcagttaaaatgcgacacagctcaacagatgcattttgtgaagcaaatcctgagtaaatctgtaaggctggctaagaccaacttataaagtgccacatagacag

SEQ ID NO: 82074 - DNA, 586 bp, Homo sapiens
tctaccagtacggcaactactcctgggacctggcagacgaacagaacgtgagcgctgccaccagcacccaggctgcgggggtaccggagccccagccctggccctgagggagaaggaagtcagggccggggctgccccaatcctgtctcctgtgcgcaggtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtggcagccgcagtcctggtcccaccatccccatgcttccccactcatctctggagggcccactctggggcacctccagggaccagagcccagcatggaaggccccttgggggaaaagcatgaggggcagggggcgggagctggacaggatttcaatggtgatgggaggaggggagcacctgctgactcccctcaccccaccctagaaggggcagcctggggatagtggagaccctccgcccacccctcctggccaccccaccac

SEQ ID NO: 82075 - DNA, 520 bp, Homo sapiens
tctaccagtacggcaactactcctgggacctggcagacgaacagaacgtgagcgctgccaccagcacccaggctgcgggggtaccggagccccagccctggccctgagggagaaggaagtcagggccggggctgccccaatcctgtctcctgtgcgcaggcctacctcaagtggatggcagagggtggcaaggaccagcagctgcccggcctggatctcacccatgagcagctcttcttcatcaactatgcccaggtggcagccgcagtcctggtcccaccatccccatgcttccccactcatctctggagggcccactctggggcacctccagggaccagagcccagcatggaaggccccttgggggaaaagcatgaggggcagggggcgggagctggacaggatttcaatggtgatgggaggaggggagcacctgctgactcccctcaccccaccctagaaggggcagcctggggatagtggagaccctccgcccacccctcctggccaccccaccac

SEQ ID NO: 82076 - DNA, 359 bp, Homo sapiens
tcattagccacaatttttaaaaaattggacgtcatagtttacatgttagagggcgttttgaagctttgtatttttaaattaaatgttatagagtgatgttttcatgtttcataattgttttcatctgtgcatttgtagccaacttgaaaacaaagatccagggattactacttaaaagccagacttcttggaggttatagtgatgattttgatagtatcttgagccgtctcataataacctcagggtgagagatggccaacaggagacagtcgagggacttagaaatctgaatgaaatctgaagttcaaatcttcagacatataccactaaccaagagattggtacctcagtctagtat

SEQ ID NO: 82077 - DNA, 497 bp, Homo sapiens
aaatggaggtgctggcagttggagatcaggctgtccatagcacactgatgtggcacaggcaaggaatatggctgaggcaccaatttgctgctactgctgtctaacaggcattggaagtcttatgtgttcaaaaataaacttctgatttctactcccaaacctgctcttcccacatcttccccgtctcagtaggtggcagctctatttgtccggttactgagaccaaatattagagtcctccttaatttcctctctctcatgcttcacattcagtttattaataaatcctgttgacagcctgggcaatatggcaagaatccatctcacaaaataaataaataagccaggtgtggtggtacgtgcctgtggtccccggttactcgagaagctgaggctgaggatcagttgagcccaggagttgaggctacagatagctatgatcacaccactgcactccagcctgggcatcagtgagagcacatttcttaaaaaaaaaa

SEQ ID NO: 82078 - DNA, 716 bp, Homo sapiens
gttctcttttgcttaatacaataatgataaaatactcaaatttctatcaataatcatgccaaacagcaagtgcccatctgggaggcactggaggttccagcatcatttctgatctgagaacacccagatggaacacagggtctaggcagatccatctggaggagcggtgtgcaggaagattagagtggagggccggcagggcggtgccaccagtcagggggctgttggtgtcacccagctgagacctagggcaggcctggacccagctgagttcatgttcaccaagtagggaggtgccggtggaagcagaagaggcgagcacgtgggagagactgcagaggagagtgaagaggttggagtcacaatgcctatgggagccgaaggaaaggaaagagggctgggattgagaataagggcccaccttaaagcgggaagggagaaaggcagaaaatgaaatgaatgcgcagttaaagggaagagttgtgttttagttgtgttgagttgaaggtgaacgtgggaccctgtctggcaggctgtcggaatatagatctggaggatggaagagagcacgagactgggattatagattggagccattcccatagagaacattatcggatatcaggaaatgtgtgaggtcatccaaggagagggaatacagggagaaaatagcaaatccacaggcacgtgtgtgttctgtggtctggaagaagaag

SEQ ID NO: 82079 - DNA, 1017 bp, Homo sapiens
  misc_feature (12)..(12): n is a, c, g, or t
attcggcaccanggtgggcagggtggaagacagcatgaagaggtgggaacccaagagaatgcaggcccccctgaaatacagtgctgtgatggagtggacttcagagggccgattatacacatctcttcccaaagctcttttcggtgtcctcatcttggtatcaccagatgctgagcctatggaattaaaatagaggtctcctaaaaaagaagaagaatcagactggcatcagatgatccagaaaaaatggagggagaagacaacagagcaagaccttcaaagttatgaaaggactactatatccagtcaaactgtcaattaaataagaaaacaaaaataacctattttgagacatgtgaaaactgcagaggtttacctctcatgcagccctttccataaatttttttgaggatatactccagtaaaataaagaggaagatgtagattgtacaaaatcatagatctaccataactcagaaaagatgcctctgatcacccattctaggtcaattctgacctttctttattacaccaccttggtcatttccttcttaggcttataaaaatctatatttatttcctgtaagtttatttaaaatgtatttcttaacttgcttattcttggcctcacccattagaaggtaagctccataaaaggtgactatgctgtatcaaggaatcttgtatagtgtctggtatttaggtaacagacaataaatattaaagaatgaatagcatatctctattttttaacttgagttaaaccaaactccataggtgagacttctaagagcctttaaaatgctttttgaattttcataatggaggcatagtaagaattatagcctaaacatagaatcctggtagcatcttagatggtggttaatgctttgtgtaacacactctggcacttttaaaattgtaaatcagtttaatttttatcacaaatgtccaacacttttctcttatgaagaagtaagagtcataaatcaattgagagatttctcccaaaaactg

SEQ ID NO: 82080 - DNA, 984 bp, Homo sapiens
  misc_feature (6)..(6): n is a, c, g, or t
  misc_feature (28)..(28): n is a, c, g, or t
cgtcanagttacactccgtcacccgtgnagcagtgcactggcatgatctcggctcactgcaacctccatctttcgggttcaagtgattctcctgcctcagactcccaagtagctgagattacaggtatcaccagatgctgagcctatggaattaaaatagaggtctcctaaaaaagaagaagaatcagactggcatcagatgatccagaaaaaatggagggagaagacaacagagcaagaccttcaaagttatgaaaggactactatatccagtcaaactgtcaattaaataagaaaacaaaaataacctattttgagacatgtgaaaactgcagaggtttacctctcatgcagccctttccataaatttttttgaggatatactccagtaaaataaagaggaagatgtagattgtacaaaatcatagatctaccataactcagaaaagatgcctctgatcacccattctaggtcaattctgacctttctttattacaccaccttggtcatttccttcttaggcttataaaaatctatatttatttcctgtaagtttatttaaaatgtatttcttaacttgcttattcttggcctcacccattagaaggtaagctccataaaaggtgactatgctgtatcaaggaatcttgtatagtgtctggtatttaggtaacagacaataaatattaaagaatgaatagcatatctctattttttaacttgagttaaaccaaactccataggtgagacttctaagagcctttaaaatgctttttgaattttcataatggaggcatagtaagaattatagcctaaacatagaatcctggtagcatcttagatggtggttaatgctttgtgtaacacactctggcacttttaaaattgtaaatcagtttaatttttatcacaaatgtccaacacttttctcttatgaagaagtaagagtcataaatcaattgagagatttctcccaaaaactg

SEQ ID NO: 82081 - DNA, 710 bp, Homo sapiens
ggggctggttcccctaatcgccacattattccggggtcaactattgtttaatcagcatggtcatattgacgtccatgcatgttgttaatacttgagccctcaacagagaatatgtgcacagttcagggatctattgatgtctttctacactgccaggtctctatctctctctccccttcccggtctgtgaaaagtctctgcgtgtctctttgttgccactatcttgagtgttctggatgctgatacaaggccagttgaaggtggattgtccatctgaagtgctcctgtgtgattactaggctacaggacagtcacaaacatctctccttcctttcctcccctaagaagctttgagccctgattcttcaccagggtggtagaggataagtcttagagaaccatgacccctcgtgggaacatattaaaatgaggggggaatatactgggaggaaacaatagtttgataaaagcttcccagttggttctaacaggcctcctccgggttgtagttggatcctctgctcttggtagagacagggaaggtgccatggaattggccatgggtccagatcacctggacatcctcaggcacaggactgggaagtgactgactgagatttaagggataggagaaaagagagaaaagaaggcaggagcccaaggatgtaatttctttttggacccatcttctttttcaggtgcttaatatc

SEQ ID NO: 82082 - DNA, 399 bp, Homo sapiens
gcaagagatgtcgcttattgtctagcaccatgggactgtatcggccaagggtggtgcctgagtggctggtcttgttttctttgcctcctgtttcttttcctctccctcagccaagtctcaggatagatgcgaagtatagtccggttagagaaggtgaatatatgctctgggttatacgcctatgcatgtcaggtcctgggagtgtgtgtgatgcatggtgttccgataggcaggcatgagtctgtccatatgtggttatgaagtttctcaatagctgatggttaggtatcacgagtcaggagtcctgtgagtcctactctgttggacaaagtggtcatcttttttctttgctaactttaagttgaaagtttgtttgaggggctagttggaaaggcattg

SEQ ID NO: 82083 - DNA, 451 bp, Homo sapiens
aaaaaagtcatggcaatgtacagtcactgaatagatcctggatttaaaaataactatacacatttatatatatagttatttcattatatatatagttctataaccattattagaacaatatgagaaatttgaacatagactatatattagataatagtattgagtcaatgataaatttattgagtatggaaatcataatgtgattatacagaagaacatctttgtttcaggagattatgctaaatatttaggtagatggctcagccaaaaaagtatgtgtgagagagggggaaagaaagagagagagagaggcagaaacagggataaaggaagtacaggcacaatggctcatacatgtaatcccagggctttggcaggctgaggtgggaggattgcttgaggctgggagtttgagaccagcccgggcaacatagtaaaatcctatctctac

SEQ ID NO: 82084 - DNA, 356 bp, Homo sapiens
tgttctttagatgtacgggccttgtcccagggtcagtctcttggcttttgcttttccttttgctagaagatttctcaccagatcctgtgtgtctggctccttcttatcattgagtcttaattcaaatgtcagtgtcatatggggagccctccttgaccatgcccatggaatccacaccccagtccctctcaaccccatcactctttcttaatgccccatcactctttcttaatagttcttatctgaaatccttgtatatttatttgattattctctctttctccatcagaatttaagttccatgctggcaaggacgatgtctgttttgttcattattgtcttgccagcacattcta

SEQ ID NO: 82085 - DNA, 668 bp, Homo sapiens
agcggtaattgctgaagctggggaagtaaattattaaaatacttttaaatatttcaaaaatttcataacaaaaattttaaataatcacacacaaagcacagtgggaagatgccatcatcctaaatggaagctaatggaatcaaattcacaaattgtcaatgcgaatataatgtcaattgacattcttattcaagaaaaatattgtaagaatcctaagaaaagcaaggcaaacaaaaaacccatcaaaaggtacttgcttatacttatcaatggcttttaggtactcaatttaatttacttaatataaaaaaaatttttttaggtacagggtcttactctgtcacccaggctggagtgcagtgaagcaatcataattcaccaaagcccaaactcctaggctcaagcaattcctcccacacctcagcctcccagtagctgggattaccagtgggtgccaccacacccagctaattatggttttttagaaacagggtctccctttgttgcccaggctgttctcaaagtccagagctcaatcaatcctcctacttcagcctcccaagtagctgggatcacaggcatgagccaccatgggcacctggctctttatttatttaaaaccgcaaattgatagtttacctgaagatgtgatccaattcccaaggtat

SEQ ID NO: 82086 - DNA, 450 bp, Homo sapiens
ttaccaatcctggtattttttttttttggaccagatctcatccttctgaagtatgaggtacagtgtaacactgagcttggtgctagaggaattatggactctaaagcagtagttctcaagtctagccacacattggaacacccaagggagcttttaaacatggagcctaggactccacccccagatattctgatgtaattagtctgaggtaggacatggactttttgaaaagctccccagagatttcttatgtgcagccagagttgagaacaactggcttaggggaaacccagactctgctttccactctctacaaagaatcccttggccgggtgtggttgctcatgcctatcatcccagcactttgagaggccgaggtgggaggattgcttgacgccaggagttcaagaccagccttggcaacatagcaagatcccatctctacaaaag

SEQ ID NO: 82087 - DNA, 769 bp, Homo sapiens
gggagatggggatgcatgtattgaaattctgccacatggtagatggggctgtctttgaagatgaacatatttgaggtcaatctcactgcccctcctccaatctcaccctccagcgttttgatccaagtgcccacagttctgatgaatgtcaaaggcaagcttgaggagggaagaggaaatgattagtcctttacactccaggtcaatttactaaggatgaattctccaaatgatcagccggattttcaaatggtgtcagaagcggtatccgaagtggagcttctagcgaccactaggagggctgagtgaacacgcaagctacctgcaggacccacttgtctcagattttggagctccgtggatttgtgttttgagctctccgagtttctttgaacaaatttctgatccaaactgggtttggagtcgcaacagaaactggactgggtccaggaatggatttgatccagaaattaactggcttggatcaagttagaggcctcttacgtctgactgggtgagaaaggaacaggtggattttgaacattcacagggatttttgcattatatccctttgtttcatttttcttgcacgcttaggtaggggaaaaaaatcattggctaagttaatcaagagaacctgagcataaagccaatatttgaggtaaaaatgggatccttaatttctggaaaaccgagttccttctggcttatactttaggcctgggaggcagtgaagtcttacagaaacagcaaaatcttactaaagata

SEQ ID NO: 82088 - DNA, 435 bp, Homo sapiens
agtgatgaaattacaggtttgagccaccgcgctgggctggtgtcatagtcttttatgacattgccatttttgagcaatacagacaagtggaatcatctctccgtttaggtttatctgaggtttcctcatgactgcattactgctgaactgatgttgtgttttttaacatatcaggaagcttatgatgttgatttgtcccctctaatgataatgtcaacttgtttcatcctgctgaacccacagttggaatcaccccaaaagccttagcaggggagtttccacaagggagtgccccagaccttttccaggtggggccagttgggattccaagggaagtagcacttagcactaaataaacaacagggtgatcagtccaaagcatttatttattcatttagacagggtctcgcttgctctgttgcccagactggagtg

SEQ ID NO: 82089 - DNA, 429 bp, Homo sapiens
gggacttaattgtacagaacacttacatcgtgttatatataagccatgtacagttgtaaagtctgcataataacctgtggcgctatttatccccattttatagataggtaaactgaaacaggctgaataatttgccaaatgctcacacagctcttaagtggcagagcctggcttcaaatcccatcagctccaacagccatactctcaactgctgctgctttctctagtggagaaagagaaatatttttcgagtgtggggaggacaaggaaagagtagtgcaggggagcgattcataattctagaatagtggtgtaatagaactcaaaattgaatggatatagttgtttagtgtaacaatttatactttcatttgagggaagaaacttatctttgttgggaattggtatgttaccattatgaaactcttt

SEQ ID NO: 82090 - DNA, 138 bp, Homo sapiens
tgtagattggataaattacatttattacaaccaacagcagtttattataaactacactagagatgctattaaagaaatagctgagcaattaggggctactagccagatggcttgggaaaatagaatagccttagacat

SEQ ID NO: 82091 - DNA, 421 bp, Homo sapiens
cttgatctcctgacctcatgatccacccacctcggcctcccaaagtgctgggattacaggcgtgagccaccacgcctggccataaactttagtttttaacttaaaaattttaaaagcctaattcctgaaattaaagtatataattaatgaacatcaaaatgcctaatgttggcgttgctgttatactgtttcgttcattagcaagtaaaataacctttctgggcatcactttaattatacaatgatatgatagctagatcctttttaactctgtgttacacactgtatatgtaattaatgttaaattgtttatgaaagtgaaattaagtgctataaagcatagtggaaggaatattatgcttctgatccaggagttattgagttcaaattctttgtaactattgtgttactttggcttata

SEQ ID NO: 82092 - DNA, 670 bp, Homo sapiens
agagaaataatttggaagttacacttgattatcaatgtgatttatgcagggatgaaaacagaacaccaacagtgaacttatgtcctgagagccagcaactatggcttatgtcaaaaatggcctgaggcctgtatttgtatgaactatgaccttagaatgatttttacattttaaaaggttgtaaaaagaagaaagagaaaaagaagacgcagaagggggtggaggaggaggatctgcagcagcccagcaacagaggccaaacggggctctcaaaacctaaaatatttaatatatagtcctttacagaaaaaaatttggaactccactttatacaatgaaaaggatgttgtcccatattagcagcatatagctagaatatacatctatttatgctttaaattaaaatattccagatatgtatgtccttgtttaaaaagaagataattagcttcggctgatttttaaaatattgctcagtaaatttgatcacattggatataaaattttccactagtagaagtgcatacaaaatacttactctcttattgttcatttaccttattggcttccagtcagttcacctccctttagtggcaggattctaaaggctttattgccagatctcacattttttaatcaccaggcttcctgaatagtgttttgctcctgt

SEQ ID NO: 82093 - DNA, 791 bp, Homo sapiens
ggtaaattttctaacaagatgaactgccttctgatttgaacattctgatcttggtagcataatctgccatgtgtacatatatatattttatgtgattcattattgtaggaataattactgaaatttcctaagttgttatacacttaggattatacacatatgattaaagaccttgttgagacttaatttttaacatctataaactggaaaaatgtgcagacatcttgtttctattaatatattgagaaaagttttcattaatattaatatttcttaggaaatctagctttataaaacatctacatgtttctttcatattttggttggaatggtttagcacctttgtttgcatagcttagtgagaatttagtctttgtggaatccttaaacacttttgacgctacagaaactttagttggctgggcacagtggcacatgcctgtaatcccagcactttgtggggctgaggcaggcagatcacttgagcccaagagtttgagaccagcctggacaacatggcaaaacccagtctctaaaaaaaaaaaaacaaaaaaccaggcatggtggtgtgcacctgtggtctcagctactcgcgatgctgaggggggagaattgatttagcttgggaggtcaaggctgcattgcacttcagtctgggcaacagagtgagactctgtctcaaaaaaacagaaaaccagaccaaccttccccttcaaaactttagtaacttgggattatatgtagccttggaatatttattctgtgctggccaacaatgaacagtgacttct

SEQ ID NO: 82094 - DNA, 460 bp, Homo sapiens
tactacaggaccttaagctatcggtcaatacatgggaagataaactgtataaaactatctgagctgtgaaaagaagtcactgttcggccaggtgcaatgacttaatgcctgtaatcccagcactttgtggggctgaggcaggcagatcacttgagcccaagagtttgagaccagcctggacaacatggcaaaacccagtctctaaaaaaaaaaaaacaaaaaaccaggcatggtggtgtgcacctgtggtctcagctactcgcgatgctgaggggggagaattgatttagcttgggaggtcaaggctgcattgcacttcagtctgggcaacagagtgagactctgtctcaaaaaaacagaaaaccagaccaaccttccccttcaaaactttagtaacttgggattatatgtagccttggaatatttattctgtgctggccaacaatgaacagtgacttct

SEQ ID NO: 82095 - DNA, 454 bp, Homo sapiens
acttttgtgtgtgtgtttgatgtgctggcaactggggacttggtaactggggagggatagctcttctcaggaagagctaattcttagagatacagggagcatgcttttcatatgcaaactactcaaactggagtccacacttccccaacctcctctataggactcttactctcctgcccgatattcccctgctctaatcatcttggggccaggtaccaggcaactcaggacggccactacacctccagagcccactgacattattaaaactagacaattctaagctgcttgccctaccttgaccttattccttttgttgcaaaacgcaataaagggtcttgccacattttccttctgctccctctgcctccggactgaccctggtgctttcctttgtgggccttcgtggcttacctcgtgtttctaggaacctgcaagtgtaaaaacttctttc

SEQ ID NO: 82096 - DNA, 492 bp, Homo sapiens
ttttactccctgctgtaaggtatcagtatcatttgttgaaaagacttttctttgcccattgaattgctgtggcaattttgttgcaatcagttggccatataagtgttggtttatttttagactcttttctgttccagtgatttgtatatctgtctttttgacaatagcacactgtctgtatattatagctttataataaggcttaaaacctggtaatttaagtcctctaacttacctctttttgaaaattgctctggccaggtgccatggctcatgcctgtaatcccagcactttgggaggctgaggcgggtagatagcttgagcccaggaattctagaccagcctaggtaacatggtgaaatccgtctctaaaaaaaaaaaacgaaaattagctgggcgtggtggtgcgtgcctgtatttgggaggtggaggttgcagtgagctgtgattgtgacactgcactccagcctgggcaacagagaccctgtctc

SEQ ID NO: 82097 - DNA, 280 bp, Homo sapiens
tgatacgaatcgaggcggtaccctggcaaatggcagtaataatagtttctataccataggcttgttgtgagaactaatgaattagtttatggagagcacttggagcagtgctgggtatacaggaagctaggctctaagtgctagctgtcacctacattccatagtattctccaaaccttttatttttccagtataattctaagttccttgaggccagggaacaacgcattttacttatagaattgcagtaattgctggcagtgtcatggggcgtagcagg

SEQ ID NO: 82098 - DNA, 654 bp, Homo sapiens
ttatgggaatcatagctggtatttttaacttttttcttccactagctatttcatattctctctttttttcagcaagcacttcagctggttgtggttccttgctcaggggtggaggaagggaatgacgcaaaacttcattcctaaaggggctagacctttaacaattctgcctgtttggggttgttataattttccattaacttttcttacagaatatggtattacttaaaaacacccccaaagttctcctgaattctagacatcttccttaatttctactggtagtaatagctcattttctcctaagaatcaggattaattaccccagccagtatggtaattgtcttttttttttcatgttggtttattggtatgaggagaacaagatggtcaggtggcagtatcagtttccattttaacattggtatgtactttggtggaaacgttcttcctgtggaaactaagaccattatatctgcagagcacaaaggtacaaagaaggacaggaagcaaaattttcactagtggatcattaaagataatattgagagggagccacttccatttctaccacttaattcccaaattcatgaatgctggctgtgtgagaaatagctctcgctggatactaatgttacatcataggaacagcta

SEQ ID NO: 82099 - DNA, 376 bp, Homo sapiens
acaaggggtggaggacgacagaaaaatgtagcatggaaacgacccatgaaaaaatctattttggaggaacaggacacagaagaaaattatatacaacaattaacagagattctatgaaagaagagatcaaagacaagatgacaagacatcagcacaagatgaaagagaggctggcagttgaagaaagaaaatgatgacaaaaataatatcattgcagaagtaataaatatattaaagttataagaggcaaaatccacaaatcaaaaacaatgttgatgatgtggaaaacagtcttcaaaaaactgcacaaaatgcagaggaaaaggacaagtagatgaaagcaagtggagaagatgacagataagaaggtttgaaa

SEQ ID NO: 82100 - DNA, 450 bp, Homo sapiens
cttaatctaaacagagcctcaggcacacttcattgatcatgcctccaggctgaaaggcccccttaatgctggccagcaaatattatgtttctgaggcagccctgtgctgtcaaccacatttcctgatctactctgattagatatataaacagcttcagtaaaacagagcctgagctttgctgttaaaaatataagataaggcttccataaagattcatcaacagcagaggtgctgtctaagttagggctgagccctctgagctgaatttctttttttctttttctttttttcttttctttttttttttttcggtgttgtaagagggtcagtgagcaaacaaccacgatttataatcatgtttgaatagtggctggtgcactcactgactaagggagaccttggggaaaagaaagagttaaaagaattgagcagttcatgaagtggtttgc

SEQ ID NO: 82101 - DNA, 1183 bp, Homo sapiens
ttcctccttcattcctttctctgccccattgcctgccatgaacaacaggttcctggtagcctttgtgctatggttctgttgggaattggtgctctggcacattcctctctccatctgaggagtgtgaagagcctagatcttaaagctgaacagctgaggtgcaagtgatcgttctgttcagtaacagctgggttactttgggctgtttaacctctctgcctccgtttctccataccgcctctgtaaagtgaattctgataattaaaaaaagaataaagtggctgggtacagtggctcacacctataatcccagcactttgggaggcgagaggataacttgaagtcaggagttccagaccagcctgggcaacaagcgagaactcatttcaacaaaaaaacaaaaaaatagctgggcatggtggcacacactgtagtctcagctactcagaaggttaacatgggaggatcatttgagcccaggagttcaaggctgtagtgagctataatcacacaactgagagtgagaccctggctctttaaaaaaaaaaaaaaaaaaaaaaaagtatgacccaggcacggtggctcacgcctgtaatcctagcactttgggaggctgaggcgagcggatcacctgaggtcaggagtccgagacagcctggccaacatggtgaaatctcgtctctagtaaaaatacataaattagccgggcatggtggcgggcacctgtaatcccagctactcgggaggctgaggcacggagaatcgctggaatcagagaggcaaaggttgacagtgagccaagatcgcaccactgcattccagcctgggcgacagagcgagactccgtcaaaaaaaaaaaagtatgtaaagttcttggaatatgtgaatactcaacaaatatcactatcaatttctaaacatactgctaccaagcagatggaagtcccttttctaaggtgagcaagatgggtttcttgttgaggaggaagtttggaaagctcttcatatttattttaaggagcacttgggtagctatctcctacatttgattaaaaccggatgcaagcaagaaacttagtaaaggaaatcagatcagaaagaaaagattggcatgatgtaagtggaaaaactcagggaatacaagttttcttctaaggtcatatgtatgatttgaaagtcacaa

SEQ ID NO: 82102 - DNA, 787 bp, Homo sapiens
ctcctaagaattctctcacctgccttctgcccttaggctctgctagattgcaaatgacctgctttctttctgatcctgggctgcgttcccacccctgtcagatagtaaatcccaagtaaggtaactgctttcggcagctctgagctttcttcttggacacctaaaacccacagtcctccaggctccgatagattgcaaatgacctgctttctttcggatcctgggctgcgttcagacccctgtgggatagtaaatcccaagtaaggtacttgccttccgcagatctgagctttcttcttagacacctaatacccacagtcctccaggctccgatagattgcaaatgacctgctttctttctgatcccgggctgctgagttcggacccctgttggatagtaaatcccaagtaaggtacctgccttcggcagctctgagatttcttcttggacacctaatacccacagtcctccaggggcaagaggatgctattactgcaaagagtacagaggatgtacacccgtctataatatagttggtgatttccagaggctgagaagatattactgacaatcccgtcaacatgctgtgtgaccaccgtggattgtaatatccaggaaaacgttactgctaatgtcacaggacgtgtagaccctgccatcaaattcgtaatatcctagcgggacttcactagtcatttcacaatgcgtgtgcaccctttgatattattcgtattgtcctgaagagatgttactactgatgtcccaatgcaggtacattctctgaca

SEQ ID NO: 82103 - DNA, 280 bp, Homo sapiens
tgggaagaaatttgatatggttcagatctgtgtccccacccaaatctcatgtcgaattgtaattcccagtgttggagctggggcctggaggaaggtggttggataacgggggtggtttctcatggcttaacaccatcccccttagttgccgtcatcacatacttgtgagatctggttgcttaaaaatgtgtatcacctcctccccgctctctttctcctactctggccatgtgaaattacttgctcttccttcgccttctgccatgattggaagcttcct

SEQ ID NO: 82104 - DNA, 644 bp, Homo sapiens
ggcctataggttgtccatcctgactgtccatccctgagattcagatggccctgaactcagtcgcttagcctcagtttccccatttgtgagatcgggggaatggaaaaagtttgcagaaatcagaagtgctcttcctccagggaggtcacaagagaaatttcatcagcggtttgtcctgtggtcctttccaggaaaacatcctccccgccagcctctcacagaagagacctagatttcatctgccacgtggagcaggcggtctcagaatcccacccggagcagggtccagggcaagtcttggaggacagtcaccaagaactgctttggattcgggaacagagctgcctaacccatccgcagccctggggtcctgccctgttcctctggccccttcagggcagcgggggaagcagggaaaacagcctgtcagagatggcagagaaaccgagcaagaataattatcctggaaaagactttcagaagtaaccaccagaaacttcgagtccccagatccaaacagctgagaatgtggggcctgagccacgctctgactccactcccaccacatgaggagaaacaagagctgcttttctggaagacttgaacaacccctgctgtgctctggaaggtagtgtcatttctca

SEQ ID NO: 82105 - DNA, 886 bp, Homo sapiens
ggactacaggcgcccgccaccatgcccggctaatttttttttgtatttttagtagagacagggtttcaccgtgttagccaggatggtctcgatctcatgaccgcgtgatccgctcgcctcagcctcccaaagttgtggaattacaggcgtgagccaccgtgcccagcctattattgagaatttttaaaagaagtttaattttagtctgttcattgtagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcggatggagcaggcacgcacagaatacagaggagctctactgtggatgaaagatgtatcccaagagctggacccagacaccttaaagcaaatggaaaagtttagaaaagtatgaaaacgtatccctttccttttcttggtgtatgaaatatgaaactgccacagaataattaagataataaaatttcagatgttttttggtaaatatatgt

SEQ ID NO: 82106 - DNA, 898 bp, Homo sapiens
ccgcaaggagcggtttctggcgtggctgggtcccctgcggcggaagggcgcctcccggccacgctcgctgtagtgaaggagcgcggcagcctggggctcgtttgggtgatttccctcggcggtggaggtcgctcctaatagaggcggcggcggatcacccgaacagccttcaggcgacgtactgtaagacgatattactttaatcatcttcacatcagtatttatggaatagccacaggtgcctcatcctttagtaggagttaattatacatttactggccgagtaaacatctccgaatgtatttttttagataaggaaataaaacatttccaataaagctgaagtctcatcccacccatccgttatcagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatggtatgaaatcatagttatctatctgataattcccatttaaaataaatattagcattttttaaaatgaaagatttaatgtaaaaacaattttgtgaatagcttcttatggcaaaatatgaatatttacagttacctgttctcaaaggccccagtattctctcttctttcctcagttaatcaaatcctctgacccagatttattttttgctgatattttttttctttgagacagggtctttctctgcactccagcctaggcaacagagcaagactccgtctcaaaaaa

SEQ ID NO: 82107 - DNA, 340 bp, Homo sapiens
cggaaatcaaaattttcaaacttgtacttggatccagtattcaccattaaaatttagtcaccttctatgtatctcattattattttgccattattgactcacttgcatgtaacactagggttttaaaattccttttttaatttagttgagataaaaaaagactaaaattccttttttaatttagttgagattaaaaaaaagactaaagtaacacaatatctatatttacagaggccgacattaacaactgttaacattttgttgtatttctttctagtatttttttagataaggaaataaaacatttccaataaagctgaagtctcatcccacccatccg

SEQ ID NO: 82108 - DNA, 209 bp, Homo sapiens
attgttgggaaggtaacatttttccatggttttgatttttcccaaaagtatttatgtattgatttatttggttctgactcaggcgacgtactgtaagacgatattactttaatcatcttcacatcagtatttatggaatagccacaggtgcctcatcctttagtaggagttaattatacatttactggccgagtaaacatctccgaatg

SEQ ID NO: 82109 - DNA, 477 bp, Homo sapiens
ctttctacatcggaagtaaaaccaaaactgaagcatgtcatagccaagaaaaatagacataatgtttttaaaacagacataatacttagaagaaaatgttatgcttttggggtgcttataacatatatttgtttatagttctttaaattgtcctaataaaatttatatctcaaggtttttcactctgttcaagagacatgcactgaacttctgaagataatcgagaaataccagctaagactcaatggtatgaaatcatagttatctatctgataattcccatttaaaataaatattagcattttttaaaatgaaagatttaatgtaaaaacaattttgtgaatagcttcttatggcaaaatatgaatatttacagttacctgttctcaaaggccccagtattctctcttctttcctcagttaatcaaatcctctgacccagatttattttttgctgatattttttttctttgagac

SEQ ID NO: 82110 - DNA, 1277 bp, Homo sapiens
  misc_feature (43)..(43): n is a, c, g, or t
tatagaacaaatgagacgtgtatacacataggaggaacacaancgcgggggccttatcactgggtctcccaagaggaatcagaactttgtctttcacacactgataaccagccagtgccttcacagagtccaaagaaattaacaagatcccccaacaatggcaaccaagacatgtcagcctggttcaatctgtttgcagacttggatccactttcaaacccagatgctattggacactcagatgatgaacttcttaatgcttgactgaagttataatgtcacttcagtggccttgagacatcaattttgcaacgtatttccttcgtggaaaggatttagattgtaacccgcacacaaaagcacggtgtttgtgaatataacacctgtcagccaactttagacagatggtaaagaccacatttgaataagtacacatctttcatatcttggatttgcagctgttggtactatgtggaaaatattagaaacttctatgtggaaaatattagaaactacagagtttgcgatatttagatactgaaatttatgtcaaaataacggctaggaataattctgtcaatatggagttgagcttatttctttggaaacccttttaagttgccttgctggctgtgagaattttatatgtggataacaaagatagatagatagcatgtaaattgggttgtggtttggggtcagtttttaaatgaaatagtagcgaggaggattttctgttttggaaaacaccattagaaccagaccagctttgttttgggttagagagagtaagatttgagaactcagtttgctttaatgaaatcacagagaaacttggtacttgtttttcttcatttggaggctaaaatgtaatgttttttcattcatacaaaataatggacactccctaattccattattaaatcttgaaggggaagtagcaggataattaatttgctaagcccatcctctgcagaaacagaaaaatctatcttcccatctcctaaaactcagaatgcacagtaatacttaaggcttgtacaagtgtcttcagacccactttttcatacacttgctatatagtagtatgcagtatttatattattcctgaaaataaaatgaggggagaatattccctaagcaactggcaatagtattcctgaaatacctagaaatttctatctgaatgagggagacacttatgaacaccttatccttacatatatttgcatacttatctcatattttgtgacataattatttaacccagaatactt

SEQ ID NO: 82111 - DNA, 2687 bp, Homo sapiens
ggactacaggcgcccgccaccatgcccggctaatttttttttgtatttttagtagagacagggtttcaccgtgttagccaggatggtctcgatctcatgaccgcgtgatccgctcgcctcagcctcccaaagttgtggaattacaggcgtgagccaccgtgcccagcctattattgagaatttttaaaagaagtttaattttagtctgttcattgtagtcactccatggattcctttgggcaacccagaccagaagataatcagtcagtagtcagaagaatgcaaaagaaatactggaaaactaaacaggtctttatcaaagcaacaggaaaaaaagaggatgagcacttggtggcgtctgatgctgaactggatgctaaacttgaggtttttcactctgttcaagagacatgcactgaacttctgaagataatcgagaaataccagctaagactcaatgttatatcagaggaagaaaatgagctagggctctttttaaaatttcaagcagaacgggatgcaactcaagctggcaaaatgatggatgccactggcaaggcactttgttcttcagccaagcaaagattggccctgtgtactcctctgtctcgtctgaagcaagaagtagcaacattcagtcaaagggcagtatctgataccttgatgacaattaatcggatggagcaggcacgcacagaatacagaggagctctactgtggatgaaagatgtatcccaagagctggacccagacaccttaaagcaaatggaaaagtttagaaaagtacagatgcaagtgagaaatagcaaagcttcttttgacaagttaaagatggatgtttgtcagaaagtggatttacttggagctagtcgctgcaatatgctatctcattcgctcactacctaccagagaacactgcttggattctggaagaaaacagctcgaatgatgtcccaaattcatgaagcctgtattggctttcatccgtatgattttgtagctctcaagcaactacaagacacgccaagcaagattagtgaagacaataaagatgaacaaataggcggttttcttactgaacagctcaataagctagttttgtctgatgaggaagcaagctttgagagtgaacaagcaaacaaagatcacaatgaaaaacattctcaaatgagagaatttggagcacctcagttttctaactctgaaaatgttgcaaaagatctacctgtagattcattggaaggagaagattttgagaaggaattctcatttctgaacaacctcctaagttctggttcttcaagtactagtgaatttacccaagaatgccagactgcctttgggagccccagtgccagtctcacatcccaggagccttccatggggtctgagcccctcgctcattcttctcgattccttccttcacaactctttgaccttggctttcatgtggctggagcgttcaacaactgggtctcccaagaggaatcagaactttgtctttcacacactgataaccagccagtgccttcacagagtccaaagaaattaacaagatcccccaacaatggcaaccaagacatgtcagcctggttcaatctgtttgcagacttggatccactttcaaacccagatgctattggacactcagatgatgaacttcttaatgcttgactgaagttataatgtcacttcagtggccttgagacatcaattttgcaacgtatttccttcgtggaaaggatttagattgtaacccgcacacaaaagcacggtgtttgtgaatataacacctgtcagccaactttagacagatggtaaagaccacatttgaataagtacacatctttcatatcttggatttgcagctgttggtactatgtggaaaatattagaaacttctatgtggaaaatattagaaactacagagtttgcgatatttagatactgaaatttatgtcaaaataacggctaggaataattctgtcaatatggagttgagcttatttctttggaaacccttttaagttgccttgctggctgtgagaattttatatgtggataacaaagatagatagatagcatgtaaattgggttgtggtttggggtcagtttttaaatgaaatagtagcgaggaggattttctgttttggaaaacaccattagaaccagaccagctttgttttgggttagagagagtaagatttgagaactcagtttgctttaatgaaatcacagagaaacttggtacttgtttttcttcatttggaggctaaaatgtaatgttttttcattcatacaaaataatggacactccctaattccattattaaatcttgaaggggaagtagcaggataattaatttgctaagcccatcctctgcagaaacagaaaaatctatcttcccatctcctaaaactcagaatgcacagtaatacttaaggcttgtacaagtgtcttcagacccactttttcatacacttgctatatagtagtatgcagtatttatattattcctgaaaataaaatgaggggagaatattccctaagcaactggcaatagtattcctgaaatacctagaaatttctatctgaatgagggagacacttatgaacaccttatccttacatatatttgcatacttatctcatattttgtgacataattatttaacccagaatactt

SEQ ID NO: 82112 - DNA, 2455 bp, Homo sapiens
  misc_feature (2455)..(2455): n is a, c, g, or t
gtctgacatagcaacttggactgaaacttcgtttttgttgaaggccaaacatataagctgagaattaggcttaaaaaatgcctggtttaacctcacttggctatttactgattacatcatctgcatttatagcttaatcatctgttaaattggggttctccacgcacacaggatcatgtggttgtgtttgtatatattaggagatatctataacctgaacatatacatagagagatgggttatgctccctggttaactaaaacgtggaaactttctaaagatgtgagagagctcttaaggcaattataaatagtcttttaaggaagattcatattgtatgttctgtgttgcaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccggtgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcactaaaaagggggggccggtacccaattcggccctattagtgagtcgaataccaattaaattggcccgtcgtttaccacgctggacttgaaaaaacccctgcgtacccacttaaatggccn
